US012630826B2

(12) United States Patent
Nicholas et al.

(10) Patent No.: US 12,630,826 B2
(45) **Date of Patent: *May 19, 2026**

(54) RNAi AGENTS FOR INHIBITING EXPRESSION OF XANTHINE DEHYDROGENASE (XDH), PHARMACEUTICAL COMPOSITIONS THEREOF, AND METHODS OF USE

(71) Applicant: Arrowhead Pharmaceuticals, Inc., Pasadena, CA (US)

(72) Inventors: Anthony Nicholas, Oregon, WI (US); Tao Pei, Middleton, WI (US); Zhao Xu, Brookfield, WI (US); Daniel Braas, Madison, WI (US); Zhi-Ming Ding, Waunakee, WI (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 723 days.

This patent is subject to a terminal disclaimer.

(21) Appl. No.: 18/050,901

(22) Filed: Oct. 28, 2022

(65) Prior Publication Data

US 2023/0125671 A1 Apr. 27, 2023

Related U.S. Application Data

(63) Continuation of application No. 17/748,767, filed on May 19, 2022, now Pat. No. 11,629,349.

(60) Provisional application No. 63/213,097, filed on Jun. 21, 2021, provisional application No. 63/323,430, filed on Mar. 24, 2022.

(51) Int. Cl.
*C12N 15/113* (2010.01)
*A61K 31/713* (2006.01)
*C12N 15/11* (2006.01)

(52) U.S. Cl.
CPC ........ *C12N 15/1137* (2013.01); *A61K 31/713* (2013.01); *C12N 15/111* (2013.01); *C12N 15/113* (2013.01); *C12N 2310/14* (2013.01); *C12N 2310/315* (2013.01); *C12N 2310/321* (2013.01); *C12N 2310/346* (2013.01); *C12N 2310/351* (2013.01); *C12N 2310/3515* (2013.01)

(58) Field of Classification Search
None
See application file for complete search history.

(56) References Cited

U.S. PATENT DOCUMENTS

| | | | |
|---|---|---|---|
| 5,885,968 A | 3/1999 | Biessen et al. | |
| 5,998,203 A | 12/1999 | Matulic-Adamic et al. | |
| 11,629,349 B2 * | 4/2023 | Nicholas ............ | C12N 15/1137 514/44 A |
| 2008/0113351 A1 | 5/2008 | Naito et al. | |
| 2012/0052487 A9 | 3/2012 | Khvorova et al. | |
| 2019/0125316 A1 | 5/2019 | Tariyal et al. | |
| 2019/0192691 A1 | 6/2019 | Barrett et al. | |
| 2020/0299698 A1 | 9/2020 | Fitzgerald et al. | |

FOREIGN PATENT DOCUMENTS

| | | |
|---|---|---|
| WO | WO-0053722 A2 | 9/2000 |
| WO | WO-2008022309 A2 | 2/2008 |
| WO | WO-2011104169 A1 | 9/2011 |
| WO | WO-2012083185 A2 | 6/2012 |
| WO | WO-2013032829 A1 | 3/2013 |
| WO | WO-2013158141 A1 | 10/2013 |
| WO | WO-2017019660 A1 | 2/2017 |
| WO | WO-2017156012 A1 | 9/2017 |
| WO | WO-2018044350 A1 | 3/2018 |
| WO | WO-2020238766 A1 | 12/2020 |
| WO | WO-2021257782 A1 | 12/2021 |
| WO | WO-2022223557 A1 | 10/2022 |

OTHER PUBLICATIONS

OMIM, Xanthine Dehydrogenase, XDH, Entry 607633, pp. 1-3, https://omim.org/entry/607633, retrieved on line Jun. 25, 24, 2016 ( Year: 2024).*

George et al. Hyperuricemia, StatPearls, pp. 1-16 https://www.ncbi.nlm.nih.gov/books/NBK459218; Accessed on-line Jun. 25, 24, 2024 (Year: 2024).*

Gout. Centers for Disease Control and Prevention, pp. 1-5, https://www.cdc.gov/arthritis/basics/gout.html, accessed on-line Jun. 24, 2024, 2024 (Year: 2024).*

Kliuchnikov et al. Molecular Therapy: Nucleic Acids vol. 36, 2025, pp. 1-14 (Year: 2025).*

Baenziger et al. Galactose and N-acetylgalactosamine-specific endocytosis of glycopeptides by isolated rat hepatocytes. Cell 22:611-620 (1980).

Biessen et al. Synthesis of cluster galactosides with high affinity for the hepatic asialoglycoprotein receptor. J Med Chem 38:1538-1546 (1995).

(Continued)

*Primary Examiner* — Brian Whiteman

(74) *Attorney, Agent, or Firm* — Paul VanderVelde; Meibo Chen; Mitchell Porter

(57) ABSTRACT

The present disclosure relates to RNAi agents, e.g., double stranded RNAi agents, able to inhibit xanthine dehydrogenase (XDH) gene expression. Also disclosed are pharmaceutical compositions that include XDH RNAi agents and methods of use thereof. The XDH RNAi agents disclosed herein may be conjugated to targeting ligands to facilitate the delivery to cells, including to hepatocytes. Delivery of the XDH RNAi agents in vivo provides for inhibition of XDH gene expression. The RNAi agents can be used in methods of treatment of diseases, disorders, or symptoms mediated in part by XDH gene expression, such as gout and hyperuricemia.

17 Claims, No Drawings

Specification includes a Sequence Listing.

(56) References Cited

OTHER PUBLICATIONS

Connolly et al. Binding and endocytosis of cluster glycosides by rabbit hepatocytes. Evidence for a short-circuit pathway that does not lead to degradation. J. Biol. Chem. 257:939-945 (1982).

Czauderna et al. Structural variations and stabilising modifications of synthetic siRNAs in mammalian cells. Nucleic Acids Res. 31(11):2705-16 (2003).

Iobst et al. Selective sugar binding to the carbohydrate recognition domains of the rat hepatic and macrophage asialoglycoprotein receptors. J Biol Chem 271:6686-6693 (1996).

PCT/US2022/034102 International Search Report and Written Opinion dated Oct. 31, 2022.

* cited by examiner

RNAi AGENTS FOR INHIBITING EXPRESSION OF XANTHINE DEHYDROGENASE (XDH), PHARMACEUTICAL COMPOSITIONS THEREOF, AND METHODS OF USE

CROSS REFERENCE TO RELATED APPLICATIONS

This application is a Continuation of U.S. patent application Ser. No. 17/748,767, filed May 19, 2022, which claims priority from U.S. Provisional Patent Application Ser. No. 63/213,097, filed on Jun. 21, 2021, and U.S. Provisional Patent Application Ser. No. 63/323,430, filed on Mar. 24, 2022, the contents of each of which are incorporated herein by reference in their entirety.

SEQUENCE LISTING

The instant application contains a Sequence Listing which has been submitted electronically in XML format and is hereby incorporated by reference in its entirety. Said XML copy, created on Nov. 14, 2022, is named 58651_713_301 Replacement_SL.xml and is 2,541,483 bytes in size.

FIELD OF THE INVENTION

The present disclosure relates to RNA interference (RNAi) agents, e.g.. double stranded. RNAi agents. for inhibition Xanthine Dehydrogenase (XDH; alternatively referred to as XO, XOR, xanthine dehydrogenase/oxidase, xanthine oxidoreductase, or XAN1). pharmaceutical compositions that include XDH RNAi agents, and methods of use thereof.

BACKGROUND

Gout is a progressive inflammatory arthritis caused by hyperuricemia (elevated serum uric acid levels) and deposition of monosodium urate crystals in joints and tendons. Gout is estimated to affect 0.6% of the world population with a substantially higher prevalence in certain geographical regions and ethnic groups. Gout patients without receiving a urate-lowering therapy suffer from recurrent episodes of gout flare (inflammation response) and ultimately can develop advanced gout, which is characterized by chronic joint pain and activity limitation.

Xanthine dehydrogenase is a molybdenum-containing hydroxylase that catalyzes the production of uric acid from xanthine. XDH is highly expressed in liver and gastrointestinal tract. Hepatocyte-specific ablation of XDH or global inhibition of XDH activity reverses hyperuricemia phenotype in animal models.

Small molecule inhibitors of XDH have been widely used for urate-lowering therapies. However, a large population of gout patients are intolerant of or refractory to these therapies, and some serious side effects include increased risk of death. There remains an unmet need for novel XDH inhibitors, such as XDH RNAi agents, to reduce hepatic XDH levels and treat hyperuricemia and gout.

SUMMARY

Disclosed herein are RNAi agents for inhibiting expression of an XDH gene, comprising an antisense strand comprising at least 17 contiguous nucleotides differing by 0 or 1 nucleotide from any one of the sequences of Table 2, Table 3, or Table 5C; and a sense strand comprising a nucleotide sequence that is at least partially complementary to the antisense strand.

In some aspects, the antisense strand comprises nucleotides 2-18 of any one of the sequences of Table 2, Table 3, or Table 5C.

In some aspects, the sense strand comprises a nucleotide sequence of at least 15 contiguous nucleotides differing by 0 or 1 nucleotide from 15 contiguous nucleotides of any one of the sense strand sequences of Table 2 or Table 4, and wherein the sense strand has a region of at least 85% complementarity over the 15 contiguous nucleotides to the antisense strand.

In some aspects, at least one nucleotide of the RNAi agent is a modified nucleotide or includes a modified intemucleoside linkage.

According to some aspects, all or substantially all of the nucleotides of the sense and/or antisense strand of the RNAi agent are modified nucleotides.

In some aspects, the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholino nucleotide, vinyl phosphonate containing nucleotide, cyclopropyl phosphonate containing nucleotide, and 3'-O-methyl nucleotide.

In certain aspects, the all or substantially all of the modified nucleotides are 2' methyl nucleotides, 2'-fluoro nucleotides, or combinations thereof.

In some aspects, the antisense strand consists of, consists essentially of, or comprises the nucleotide sequence of any one of the modified antisense strand sequences of Table 3.

In some aspects, the sense strand consists of, consists essentially of, or comprises the nucleotide sequence of any of the modified sense strand sequences of Table 4.

In some aspects, the antisense strand comprises the nucleotide sequence of any one of the modified sequences of Table 3 and the sense strand comprises the nucleotide sequence of any one of the modified sequences of Table 4.

In certain aspects, the RNAi agents are linked to a targeting ligand. In some aspects, the targeting ligand comprises N-acetyl-galactosamine. In certain aspects, the targeting ligand comprises the structure of (NAG37) or (NAG37) s. In certain aspects, the targeting ligand is linked to the sense strand. In some aspects, the targeting ligand is linked to the 5' terminal end of the sense strand.

In some aspects, the sense strand is between 15 and 30 nucleotides in length, and the antisense strand is between 18 and 30 nucleotides in length. In other aspects, the sense strand and the antisense strand are each between 18 and 27 nucleotides in length. In other aspects, the sense strand and the antisense strand are each between 18 and 24 nucleotides in length. In still other aspects, sense strand and the antisense strand are each 21 nucleotides in length.

In some aspects, the RNAi agents have two blunt ends.

In some aspects, the sense strand comprises one or two terminal caps. In other aspects, the sense strand comprises one or two inverted abasic residues.

In some aspects, the RNAi agents are comprised of a sense strand and an antisense strand that form a duplex sequence of any one of the duplex structures shown in Table 5A, 5B or 5C.

In some aspects, the sense strand further includes inverted abasic residues at the 3' terminal end of the nucleotide sequence, at the 5' end of the nucleotide sequence, or at both.

In some aspects, the sense strand of the RNAi agents is linked to a targeting ligand. In some aspects, the targeting ligand has affinity for the asialoglycoprotein receptor. In some aspects, the targeting ligand comprises N-acetyl-galactosamine.

In further aspects, the targeting ligand comprises:

Further provided herein are methods of treating an XDH-related disease, disorder, or symptom, the methods comprising administering to a human subject in need thereof a therapeutically effective amount of the disclosed compositions.

In some aspects, the disease is gout.

In some aspects, the symptom is hyperuricemia.

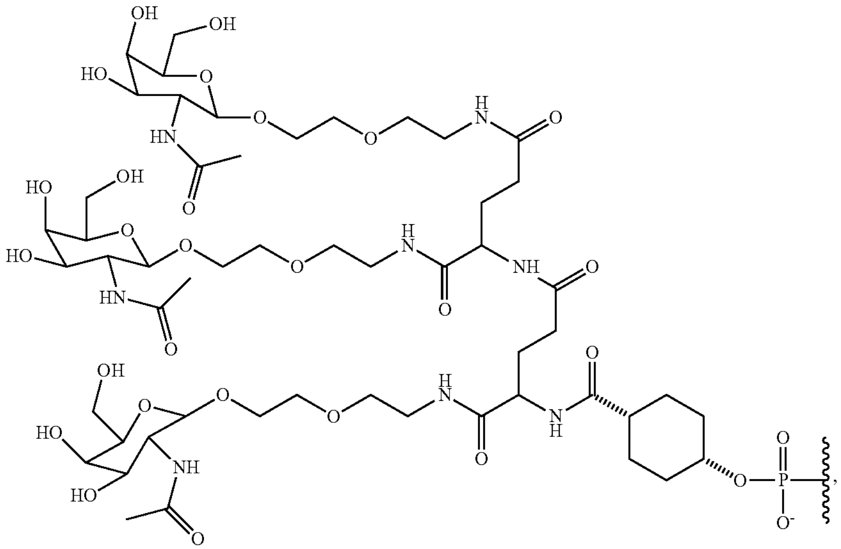

, or

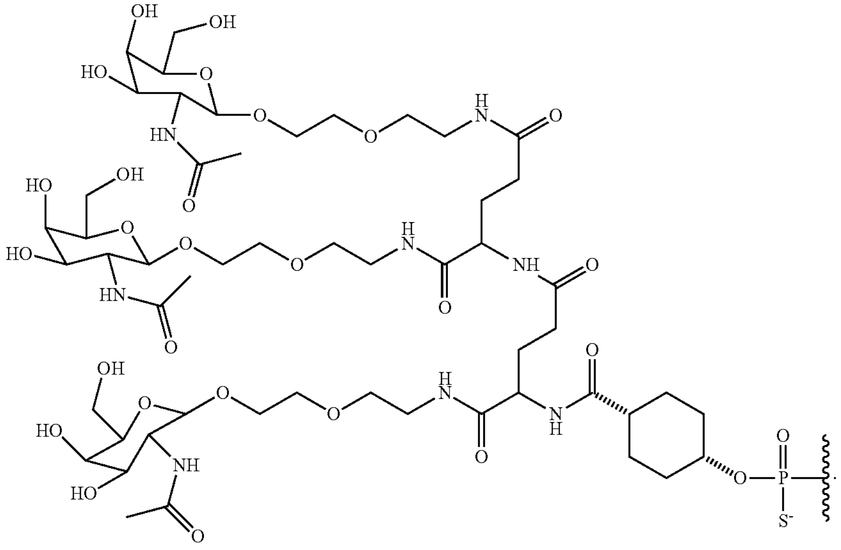

.

Also disclosed herein are compositions comprising the disclosed RNAi agents, wherein the compositions further comprise a pharmaceutically acceptable excipient.

Also provided herein are methods for inhibiting expression of an XDH gene in a cell, the methods comprising introducing into a cell an effective amount of the disclosed RNAi agents or the disclosed compositions.

In some aspects, the cell is within a subject. In some aspects, the subject is a human subject.

In some aspects, the XDH gene expression is inhibited by at least about 30%. In some aspects, the XDH gene expression is inhibited by at least about 50% in the cytoplasm of hepatocytes.

In some aspects, the RNAi agents are administered at a dose of about 0.05 mg/kg to about 5.0 mg/kg of body weight of the human subject.

In other aspects, the RNAi agent is administered in two or more doses.

Also provided herein are usages of the disclosed RNAi agents or the disclosed compositions, for the treatment of a disease, disorder, or symptom that is mediated at least in part by XDH gene expression.

In some aspects, the disease is gout.

In some aspects, the symptom is hyperuricemia.

Further provided herein are usages of the disclosed RNAi agents or the disclosed compositions, for the preparation of a pharmaceutical compositions for treating a disease, disorder, or symptom that is mediated at least in part by XDH gene expression.

In some aspects, the RNAi agent is administered at a dose of about 0.05 mg/kg to about 5.0 mg/kg of body weight of the human subject.

DETAILED DESCRIPTION

The disclosed RNAi agents, compositions thereof, and methods of use may be understood more readily by reference to the following detailed description, which form a part of this disclosure. It is to be understood that the disclosure is not limited to what is specifically described and/or shown herein, and that the terminology used herein is for the purpose of describing particular embodiments by way of example only and is not intended to be limiting.

It is to be appreciated that while certain features of the disclosures included herein are, for clarity, described herein in the context of separate embodiments, they may also be provided in combination in a single embodiment. Conversely, various features of the disclosed methods that are, for brevity, described in the context of a single embodiment, may also be provided separately or in any subcombination.

Definitions

As used herein, an "RNAi agent" means a composition that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target gene in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: short (or small) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e. XDH mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature. A nucleic acid molecule can comprise unmodified and/or modified nucleotides. A nucleotide sequence can comprise unmodified and/or modified nucleotides.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, the term "nucleotide" has the same meaning as commonly understood in the art. Thus, the term "nucleotide" as used herein, refers to a glycoside comprising a sugar moiety, a base moiety and a covalently linked group (linkage group), such as a phosphate or phosphorothioate internucleoside linkage group, and covers both naturally occurring nucleotides, such as DNA or RNA, and non-naturally occurring nucleotides comprising modified sugar and/or base moieties, which are also referred to as nucleotide analogs herein. Herein, a single nucleotide can be referred to as a monomer or unit.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an MUCSAC mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The subject matter disclosed herein encompass nucleotide sequences substantially identical to those disclosed herein.

As used herein, the terms "individual", "patient" and "subject", are used interchangeably to refer to a member of any animal species including, but not limited to, birds, humans and other primates, and other mammals including commercially relevant mammals or animal models such as mice, rats, monkeys, cattle, pigs, horses, sheep, cats, and dogs. Preferably, the subject is a human.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol  as used herein means that any group or groups may be linked thereto that is in accordance with the scope of the subject matters described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Where a value is explicitly recited, it is to be understood that values which are about the same quantity or amount as the recited value are also within the scope of the disclosure. Where a combination is disclosed, each sub-combination of the elements of that combination is also specifically disclosed and is within the scope of the disclosure. Conversely, where different elements or groups of elements are individually disclosed, combinations thereof are also disclosed. Where any element of a disclosure is disclosed as having a plurality of alternatives, examples of that disclosure in which each alternative is excluded singly or in any combination with the other alternatives are also hereby disclosed; more than one element of a disclosure can have such exclusions, and all combinations of elements having such exclusions are hereby disclosed.

The term "about" or "approximately" as used herein when referring to a measurable value such as a parameter, an amount, a temporal duration, and the like, is meant to encompass variations of +/−20% or less, +/−10% or less, +/−5% or less, or +/−1% or less of and from the specified value, insofar such variations are appropriate to perform in the present disclosure. It is to be understood that the value to which the modifier "about" or "approximately" refers is itself. For example, "about 4" includes 4.

Other objects, features, aspects, and advantages of the invention will be apparent from the following detailed description, accompanying figures, and from the claims.

DETAILED DESCRIPTION

RNAi Agents

Described herein are RNAi agents for inhibiting expression of an XDH gene. Each XDH RNAi agent comprises a sense strand and an antisense strand. The sense strand can be 15 to 49 nucleotides in length. The antisense strand can be 18 to 49 nucleotides in length. The sense and antisense strands can be either the same length or they can be different lengths. In some aspects, the sense and antisense strands are each independently 18 to 27 nucleotides in length. In some aspects, both the sense and antisense strands are each 21-26 nucleotides in length. In some aspects, the sense and antisense strands are each 21-24 nucleotides in length. In some aspects, the sense and antisense strands are each independently 19-21 nucleotides in length. In some aspects, the sense strand is about 19 nucleotides in length while the antisense strand is about 21 nucleotides in length. In some aspects, the sense strand is about 21 nucleotides in length while the antisense strand is about 23 nucleotides in length. In some aspects, a sense strand is 23 nucleotides in length and an antisense strand is 21 nucleotides in length. In some aspects, both the sense and antisense strands are each 21 nucleotides in length. In some aspects, the RNAi agent antisense strands are each 18, 19, 20, 21, 22, 23, 24, 25, 26, 27, 28, 29, or 30 nucleotides in length. In some embodiments, the RNAi agent sense strands are each 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The sense and antisense strands are annealed to form a duplex, and in some aspects, a double-stranded RNAi agent has a duplex length of about 15, 16, 17, 18, 19, 20, 21, 22, 23 or 24 nucleotides.

Examples of nucleotide sequences used in forming XDH RNAi agents are provided in Tables 2, 3, 4, and 5C. Examples of RNAi agent duplexes, that include the sense strand and antisense strand sequences in Tables 2, 3, 4 and 5C, are shown in Tables 5A, 5B and 5C.

In some aspects, the region of perfect, substantial, or partial complementarity between the sense strand and the antisense strand is 15-26 (e.g., 15, 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the XDH RNAi agents described herein includes at least 15 consecutive nucleotides that have at least 85% identity to a core stretch sequence (also referred to herein as a "core stretch" or "core sequence") of the same number of nucleotides in an XDH mRNA. In some aspects, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the XDH mRNA target. In some aspects, this sense strand core stretch is 15, 16, 17, 18, 19, 20, 21, 22, or 23 nucleotides in length. In some aspects, this sense strand core stretch is 17 nucleotides in length. In some aspects, this sense strand core stretch is 19 nucleotides in length.

An antisense strand of an XDH RNAi agent described herein includes at least 15 consecutive nucleotides that have at least 85% complementarity to a core stretch of the same number of nucleotides in an XDH mRNA and to a core stretch of the same number of nucleotides in the corresponding sense strand. In some aspects, an antisense strand core stretch is 100% (perfectly) complementary or at least about 85% (substantially) complementary to a nucleotide sequence (e.g., target sequence) of the same length present in the XDH mRNA target. In some aspects, this antisense strand core stretch is 15, 16, 17, 18, 19, 20, 21, 22, or 23 nucleotides in length. In some aspects, this antisense strand core stretch is 19 nucleotides in length. In some aspects, this antisense strand core stretch is 17 nucleotides in length. A sense strand core stretch sequence can be the same length as a corresponding antisense core sequence or it can be a different length.

The XDH RNAi agent sense and antisense strands anneal to form a duplex. A sense strand and an antisense strand of an XDH RNAi agent can be partially, substantially, or fully complementary to each other. Within the complementary duplex region, the sense strand core stretch sequence is at least 85% complementary or 100% complementary to the antisense core stretch sequence. In some aspects, the sense strand core stretch sequence contains a sequence of at least 15, at least 16, at least 17, at least 18, at least 19, at least 20, at least 21, at least 22, at least 23, at least 24, or at least 25 nucleotides that is at least 85% or 100% complementary to a corresponding 15, 16, 17, 18, 19, 20, 21, 22, 23, 24, or 25 nucleotide sequence of the antisense strand core stretch sequence (i.e., the sense and antisense core stretch sequences of an XDH RNAi agent have a region of at least 15, at least 16, at least 17, at least 18, at least 19, at least 20, at least 21, at least 22, at least 23, at least 24, or at least 25 nucleotides that is at least 85% base paired or 100% base paired.)

In some aspects, the antisense strand of an XDH RNAi agent disclosed herein differs by 0, 1, 2, or 3 nucleotides from any of the antisense strand sequences in Table 2, Table 3, or Table 5C. In some aspects, the sense strand of an XDH RNAi agent disclosed herein differs by 0, 1, 2, or 3 nucleotides from any of the sense strand sequences in Table 2, Table 4, or Table 5C.

In some aspects, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not he complementary to the corresponding sequence in the XDH mRNA. The sense strand additional nucleotides, if present, may or may not be identical to the corresponding sequence in the XDH mRNA. The antisense strand additional nucleotides, if present, may or may not be complementary to the corresponding sense strand's additional nucleotides. if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some aspects, both the sense strand and the antisense strand of an RNAi agent contain 3' and 5' extensions. In some aspects, one or more of the 3' extension nucleotides of one strand base pairs with one or more 5' extension nucleotides of the other strand. In other aspects, one or more of 3' extension nucleotides of one strand do not base pair with one or more 5' extension nucleotides of the other strand. In some aspects, an XDH RNAi agent has an antisense strand having a 3' extension and a sense strand having a 5' extension. In some aspects, the extension nucleotide(s) are unpaired and form an overhang. As used herein, an "overhang" refers to a stretch of one or more unpaired nucleotides located at a terminal end of either the sense strand or the antisense strand that does not form part of the hybridized or duplexed portion of an RNAi agent disclosed herein.

In some aspects, an XDH RNAi agent comprises an antisense strand having a 3' extension of 1, 2, 3, 4, 5, or 6 nucleotides in length. In other aspects, an XDH RNAi agent comprises an antisense strand having a 3' extension of 1, 2, or 3 nucleotides in length. In some aspects, one or more of the antisense strand extension nucleotides comprise nucleotides that are complementary to the corresponding XDH mRNA sequence. In some aspects, one or more of the antisense strand extension nucleotides comprise nucleotides that are not complementary to the corresponding XDH mRNA sequence.

In some aspects, an XDH RNAi agent comprises a sense strand having a 3' extension of 1, 2, 3, 4, or 5 nucleotides in length. In some aspects, one or more of the sense strand extension nucleotides comprises adenosine, uracil, or thymidine nucleotides, AT dinucleotide, or nucleotides that correspond to or are the identical to nucleotides in the XDH mRNA sequence. In some aspects, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some aspects, an XDH RNAi agent comprises a sense strand having a 5' extension of 1, 2, 3, 4, 5, or 6 nucleotides in length. In some aspects, one or more of the sense strand extension nucleotides comprise nucleotides that correspond to or are identical to nucleotides in the XDH mRNA sequence.

Examples of sequences used in forming XDH RNAi agents are provided in Tables 2, 3, 4, and SC. In some aspects, an XDH RNAi agent antisense strand includes a sequence of any of the sequences in Tables 2, 3, or 5C. In certain aspects, an XDH RNAi agent antisense strand comprises or consists of any one of the modified sequences in Table 3. In some aspects, an XDH RNAi agent antisense strand includes the sequence of nucleotides (from 5' end→3' end) at positions 1-17, 2-15, 2-17, 1-18, 2-18, 1-19, 2-19, 1-20, 2-20, 1-21, or 2-21, of any of the sequences in Tables 2, 3, or SC. in some aspects, an XDH RNAi agent sense strand includes the sequence of any of the sequences in Tables 2, 4, or 5C. In some aspects, an XDH RNAi agent sense strand includes the sequence of nucleotides (from 5' end→3' end) at positions 1-18, 1-19, 1-20, 1-21, 2-19, 2-20, 2-21, 3-20, 3-21, or 4-21 of any of the sequences in Tables 2, 4, or 5C. In certain aspects, an XDH RNAi agent sense strand comprises or consists of a modified sequence of any one of the modified sequences in Table 4.

In some aspects, the sense and antisense strands of the RNAi agents described herein contain the same number of nucleotides. In some aspects, the sense and antisense strands of the RNAi agents described herein contain different numbers of nucleotides. In some aspects, the sense strand 5' end and the antisense strand 3' end of an RNAi agent form a blunt end. In some aspects, the sense strand 3' end and the antisense strand 5' end of an RNAi agent form a blunt end. In some aspects, both ends of an RNAi agent form blunt ends. In some aspects, neither end of an RNAi agent is blunt-ended. As used herein a "blunt end" refers to an end of a double stranded RNAi agent in which the terminal nucleotides of the two annealed strands are complementary (form a complementary base-pair).

In some aspects, the sense strand 5' end and the antisense strand 3' end of an RNAi agent form a frayed end. In some aspects, the sense strand 3' end and the antisense strand 5' end of an RNAi agent form a frayed end. In some aspects, both ends of an RNAi agent form a frayed end. In some aspects, neither end of an RNAi agent is a frayed end. As used herein a frayed end refers to an end of a double stranded RNAi agent in which the terminal nucleotides of the two annealed strands from a pair (i.e., do not form an overhang) but are not complementary (i.e. form a non-complementary pair). In some aspects, one or more unpaired nucleotides at the end of one strand of a double stranded RNAi agent form an overhang. The unpaired nucleotides may be on the sense strand or the antisense strand, creating either 3' or 5' overhangs. In some aspects, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The XDH RNAi agents disclosed herein may also be comprised of one or more modified nucleotides. In some aspects, substantially all of the nucleotides of the sense strand and substantially all of the nucleotides of the antisense strand of the XDH RNAi agent are modified nucleotides. The XDH RNAi agents disclosed herein may further be comprised of one or more modified internucleoside linkages, e.g., one or more phosphorothioate linkages. In some aspects, an XDH RNAi agent contains one or more modified nucleotides and one or more modified internucleoside linkages. In some aspects, a 2'-modified nucleotide is combined with modified internucleoside linkage.

In some aspects, an XDH RNAi agent is prepared or provided as a salt, mixed salt, or a free-acid. In some aspects, an XDH RNAi agent is prepared as a pharmaceutically acceptable salt. In some aspects, an XDH RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administering of the oligonucleotide construct.

In some aspects, an XDH RNAi agent contains one or more modified nucleotides. As used herein, a "modified nucleotide" is a nucleotide other than a ribonucleotide (2'-hydroxyl nucleotide). In some aspects, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholino nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides, 2'-fluoro nucleotides (also referred to herein as 2'-deoxy-2'-fluoro nucleotides), 2'-deoxy nucleotides, 2'-methoxyethyl (2'-O-2-methoxylethyl) nucleotides (also referred to as 2'-MOE), 2'-amino nucleotides, and 2'-alkyl nucleotides. It is not necessary for all positions in a given compound to be uniformly modified. Conversely, more than one modification can be incorporated in a single XDH RNAi agent or even in a single nucleotide thereof. The XDH RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrimidines and N-2, N-6 and O-6 substituted purines, (e.g., 2-aminopropyladenine, 5-propynyluracil, or 5-propynylcytosine), 5-methylcytosine (5-me-C), 5-hydroxymethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine. 2-alkyl (e.g., 2-methyl, 2-ethyl. 2-isopropyl. or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some aspects, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. In some aspects, an abasic residue can be placed internally in a nucleotide sequence. In some aspects, Ab or AbAb can be added to the 3' end of the antisense strand. In some aspects, the 5' end of the sense strand can include one or more additional abasic residues (e.g., (Ab) or (AbAb)). In some aspects, UUAb, UAb, or Ab are added to the 3' end of the sense strand. In some aspects, an abasic (deoxyribose) residue can be replaced with a ribitol (abasic ribose) residue.

in some aspects, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense sense strand wherein substantially all of the nucleotides present are modified nucleotides is an antisense strand having two or fewer (i.e., 0, 1, or 2) nucleotides in the sense strand being unmodified ribonucleotides. In some aspects, one or more nucleotides of an RNAi agent is an unmodified ribonucleotide. Chemical structures for certain modified nucleotides are set forth in Table 6 herein.

Modified Internucleoside Linkages

In some aspects, one or more nucleotides of an XDH RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some aspects, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some aspects, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and $CH_2$ components.

In some aspects, a sense strand of an XDH RNAi agent can contain 1, 2, 3, 4, 5, or 6 phosphorothioate linkages, an antisense strand of an XDH RNAi agent can contain 1, 2, 3, 4, 5, or 6 phosphorothioate linkages, or both the sense strand and the antisense strand independently can contain 1, 2, 3, 4, 5, or 6 phosphorothioate linkages. In some aspects, a sense strand of an XDH RNAi agent can contain 1, 2, 3, or 4 phosphorothioate linkages, an antisense strand of an XDH RNAi agent can contain 1, 2, 3, or 4 phosphorothioate linkages, or both the sense strand and the antisense strand independently can contain 1, 2, 3, or 4 phosphorothioate linkages.

In some aspects, an XDH RNAi agent sense strand contains at least two phosphorothioate internucleoside linkages. In some aspects, the phosphorothioate internucleoside linkages are between the nucleotides at positions 1-3 from the 3' end of the sense strand. In some aspects, one phosphorothioate internucleoside linkage is at the 5' end of the sense strand nucleotide sequence, and another phosphorothioate linkage is at the 3' end of the sense strand nucleotide sequence. In some aspects, two phosphorothioate internucleoside linkages are located at the 5' end of the sense strand, and another phosphorothioate linkage is at the 3' end of the sense strand. In some aspects, the sense strand does not include any phosphorothioate internucleoside linkages between the nucleotides, but contains one, two, or three phosphorothioate linkages between the terminal nucleotides on both the 5' and 3' ends and the optionally present inverted abasic residue terminal caps. In some aspects, the targeting ligand is linked to the sense strand via a phosphorothioate linkage.

In some aspects, an XDH RNAi agent antisense strand contains four phosphorothioate internucleoside linkages. In some aspects, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some aspects, three phosphorothioate intemucleoside linkages are located between positions 1-4 from the 5' end of the antisense strand, and a fourth phosphorothioate intemucleoside linkage is located between positions 20-21 from the 5' end of the antisense strand. In some aspects, an XDH RNAi agent contains at least three or four phosphorothioate intemucleoside linkages in the antisense strand.

Capping Residues or Moieties

In some aspects, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some aspects, inverted abasic residues (invAb) (also referred to in the art as "inverted abasic sites") are added as capping residues. (See, e.g., F. Czaudema, Nucleic Acids Res., 2003, 31(11), 2705-16; U.S. Pat. No. 5,998,203). Capping residues are generally known in the art, and include, for example, inverted abasic residues as well as carbon chains such as a terminal $C_3H_7$ (propyl), $C_6H_{13}$ (hexyl), or $C_{12}H_{25}$ (dodecyl) groups. In some aspects, a capping residue is present at either the 5' terminal end, the 3' terminal end, or both the 5' and 3' terminal ends of the sense strand. In some aspects, the 5' end and/or the 3' end of the sense strand may include more than one inverted abasic deoxyribose moiety as a capping residue.

In some aspects, one or more inverted abasic residues (invAb) are added to the 3' end of the sense strand. In some aspects, one or more inverted abasic residues (invAb) are added to the 5' end of the sense strand. In some aspects, one or more inverted abasic residues or inverted abasic sites are inserted between the targeting ligand and the nucleotide sequence of the sense strand of the RNAi agent. In some aspects, the inclusion of one or more inverted abasic residues or inverted abasic sites at or near the terminal end or terminal ends of the sense strand of an RNAi agent allows for enhanced activity or other desired properties of an RNAi agent.

In some aspects, one or more inverted abasic residues (invAb) are added to the 5' end of the sense strand. In some aspects, one or more inverted abasic residues can be inserted between the targeting ligand and the nucleotide sequence of the sense strand of the RNAi agent. The inverted abasic residues may be linked via phosphate, phosphorothioate (e.g., shown herein as (invAb)s)), or other linkages. In some aspects, the inclusion of one or more inverted abasic residues at or near the terminal end or terminal ends of the sense strand of an RNAi agent may allow for enhanced activity or other desired properties of an RNAi agent. In some aspects, an inverted abasic (deoxyribose) residue can be replaced with an inverted ribitol (abasic ribose) residue. In some aspects, the 3' end of the antisense strand core stretch sequence, or the 3' end of the antisense strand sequence, may include an inverted abasic residue. The chemical structures for inverted abasic deoxyribose residues are shown in Table 6 below.

XDH RNAi Agents

The XDH RNAi agents disclosed herein are designed to target specific positions on an XDH gene (e.g., SEQ ID NO:1), NM_000379.4 *Homo sapiens* xanthine dehydrogenase (XDH), mRNA transcript (SEQ ID NO: 1):

```
  1 acagagcagt gataactacc tgccagtgtc tcttaggagt gaggtacctg gagttcgggg

 61 accccaacct gtgacaatga cagcagacaa attggttttc tttgtgaatg gcagaaaggt

121 ggtggagaaa aatgcagatc cagagacaac ccttttggcc tacctgagaa gaaagttggg

181 gctgagtgga accaagctcg gctgtggaga ggggggctgc ggggcttgca cagtgatgct

241 ctccaagtat gatcgtctgc agaacaagat cgtccacttt tctgccaatg cctgcctggc

301 ccccatctgc tccttgcacc atgttgcagt gacaactgtg gaaggaatag gaagcaccaa

361 gacgaggctg catcctgtgc aggagagaat tgccaaaagc cacggctccc agtgcgggtt

421 ctgcacccct ggcatcgtca tgagtatgta cacactgctc cggaatcagc ccgagcccac

481 catggaggag attgagaatg ccttccaagg aaatctgtgc cgctgcacag gctacagacc

541 catcctccag ggcttccgga cctttgccag ggatggtgga tgctgtggag gagatgggaa
```

-continued

```
601   taatccaaat tgctgcatga accagaagaa agaccactca gtcagcctct cgccatcttt
661   attcaaacca gaggagttca cgcccctgga tccaacccag gagcccattt ttcccccaga
721   gttgctgagg ctgaaagaca ctcctcggaa gcagctgcga tttgaagggg agcgtgtgac
781   gtggatacag gcctcaaccc tcaaggagct gctggacctc aaggctcagc accctgacgc
841   caagctggtc gtggggaaca cggagattgg cattgagatg aagttcaaga atatgctgtt
901   tcctatgatt gtctgcccag cctggatccc tgagctgaat tcggtagaac atggacccga
961   cggtatctcc tttggagctg cttgccccct gagcattgtg gaaaaaaccc tggtggatgc
1021  tgttgctaag cttcctgccc aaaagacaga ggtgttcaga ggggtcctgg agcagctgcg
1081  ctggtttgct gggaagcaag tcaagtctgt ggcgtccgtt ggagggaaca tcatcactgc
1141  cagccccatc tccgacctca accccgtgtt catggccagt ggggccaagc tgacacttgt
1201  gtccagaggc accaggagaa ctgtccagat ggaccacacc ttcttccctg gctacagaaa
1261  gaccctgctg agcccggagg agatactgct ctccatagag atcccctaca gcagggaggg
1321  ggagtatttc tcagcattca agcaggcctc ccggagagaa gatgacattg ccaaggtaac
1381  cagtggcatg agagttttat tcaagccagg aaccacagag gtacaggagc tggccctttg
1441  ctatggtgga atggccaaca gaaccatctc agccctcaag accactcaga ggcagctttc
1501  caagctctgg aaggaggagc tgctgcagga cgtgtgtgca ggactggcag aggagctgca
1561  tctgcctccc gatgcccctg gtggcatggt ggacttccgg tgcaccctca ccctcagctt
1621  cttcttcaag ttctacctga cagtccttca gaagctgggc caagagaacc tggaagacaa
1681  gtgtggtaaa ctggacccca ctttcgccag tgcaacttta ctgtttcaga aagacccccc
1741  agccgatgtc cagctcttcc aagaggtgcc caagggtcag tctgaggagg acatggtggg
1801  ccggcccctg ccccacctgg cagcggacat gcaggcctct ggtgaggccg tgtactgtga
1861  cgacattcct cgctacgaga atgagctgtc tctccggctg gtcaccagca cccgggccca
1921  cgccaagatc aagtccatag atacatcaga agctaagaag gttccagggt ttgtttgttt
1981  catttccgct gatgatgttc ctgggagtaa cataactgga atttgtaatg atgagacagt
2041  ctttgcgaag gataaggtta cttgtgttgg gcatatcatt ggtgctgtgg ttgctgacac
2101  cccggaacac acacagagag ctgcccaagg ggtgaaaatc acctatgaag aactaccagc
2161  cattatcaca attgaggatg ctataaagaa caactccttt tatggacctg agctgaagat
2221  cgagaaaggg gacctaaaga aggggttttc cgaagcagat aatgttgtgt caggggagat
2281  atacatcggt ggccaagagc acttctacct ggagactcac tgcaccattg ctgttccaaa
2341  aggcgaggca ggggagatgg agctctttgt gtctacacag aacaccatga agacccagag
2401  ctttgttgca aaaatgttgg gggttccagc aaaccggatt gtggttcgag tgaagagaat
2461  gggaggaggc tttggaggca aggagacccg gagcactgtg gtgtccacgg cagtggccct
2521  ggctgcatat aagaccggcc gccctgtgcg atgcatgctg gaccgtgatg aggacatgct
2581  gataactggt ggcagacatc ccttcctggc cagatacaag gttggcttca tgaagactgg
2641  gacagttgtg gctcttgagg tggaccactt cagcaatgtg gggaacaccc aggatctctc
2701  tcagagtatt atggaacgag ctttattcca catggacaac tgctataaaa tccccaacat
2761  ccggggcact gggcggctgt gcaaaaccaa ccttccctcc aacacggcct tccggggctt
2821  tgggggcccc caggggatgc tcattgccga gtgctggatg agtgaagttg cagtgacctg
2881  tgggatgcct gcagaggagg tgcggagaaa aaacctgtac aaagaagggg acctgacaca
2941  cttcaaccag aagcttgagg gtttcacctt gcccagatgc tgggaagaat gcctagcaag
3001  ctctcagtat catgctcgga agagtgaggt tgacaagttc aacaaggaga attgttggaa
```

-continued 3061 aaagagagga ttgtgcataa ttcccaccaa gtttggaata agctttacag ttccttttct 3121 gaatcaggca ggagccctac ttcatgtgta cacagatggc tctgtgctgc tgacccacgg 3181 ggggactgag atgggccaag gccttcatac caaaatggtc caggtggcca gtagagctct 3241 gaaaatcccc acctctaaga tttatatcag cgagacaagc actaacactg tgcccaacac 3301 ctctcccacg gctgcctctg tcagcgctga cctcaatgga caggccgtct atgcggcttg 3361 tcagaccatc ttgaaaaggc tggaacccta caagaagaag aatcccagtg gctcctggga 3421 agactgggtc acagctgcct acatggacac agtgagcttg tctgccactg ggttttatag 3481 aacacccaat ctgggctaca gctttgagac taactcaggg aaccccttcc actacttcag 3541 ctatggggtg gcttgctctg aagtagaaat cgactgccta acaggagatc ataagaacct 3601 ccgcacagat attgtcatgg atgttggctc cagtctaaac cctgccattg atattggaca 3661 ggtggaaggg gcatttgtcc agggccttgg cctcttcacc ctagaggagc tacactattc 3721 ccccgagggg agcctgcaca cccgtggccc tagcacctac aagatcccgg catttggcag 3781 catccccatt gagttcaggg tgtccctgct ccgcgactgc cccaacaaga aggccatcta 3841 tgcatcgaag gctgttggag agccgcccct cttcctggct gcttctatct tctttgccat 3901 caaagatgcc atccgtgcag ctcgagctca gcacacaggt aataacgtga aggaactctt 3961 ccggctagac agccctgcca ccccggagaa gatccgcaat gcctgcgtgg acaagttcac 4021 caccctgtgt gtcactggtg tcccagaaaa ctgcaaaccc tggtctgtga gggtctaaag 4081 agagagtcct cagcagagtc ttcttgtgct gcctttgggc ttccatggag caggaggaac 4141 ataccacaga acatggatct attaaagtca cagaatgaca gacctgtgat ttgtcaagat 4201 gggatttgga agacaagtga atgcaatgga agattttgat caaaaatgta atttgtaaac 4261 acaatgataa gcaaattcaa aactgttatg cctaaatggt gaatatgcaa ttaggatcat 4321 tttctgtctg ttttaatcat gtatctggaa tagggtcggg aagggtttgt gctattcccc 4381 acttactgga cagcctgtat aacctcaagt tctgatggtg tctgtccttt gaagaggatt 4441 cccacaaacc tctagaagct taaaccgaag ttactttaaa tcgtgtgcct tcctgtgaaa 4501 gcctggcctt caaaccaatg aacagcaaag cataaccttg aatctatact caaattttgc 4561 aatgaggcag tggggtaagg ttaaatcctc taaccatctt tgaatcattg gaaagaataa 4621 agaatgaaac aaattcaagg ttaattggat ctgattttgt gaagctgcat aaagcaagat 4681 tactctataa tacaaaaatc caaccaactc aattattgag cacgtacaat gttctagatt 4741 tctttccctt cctctttgaa gagaatattt gtattccaaa tactctttga gtatttacaa 4801 aaaagattat gtttaatctt tacatttgaa gccaaagtaa tttccaccta gaaatgatgc 4861 tatcagtcct ggcatggtgg ctcaccccta taatcccagc actttgggag gctaaggcag 4921 gagaattgct tgagcccagc agtttgagac cagcctgggc aacatagaga gctcctgtct 4981 ttaaaaaaaa ttttttttaat tagttggtct tgatagtgca tgcctgtagt cccaactact 5041 tgaaaggctg aggtggagag atcatttgag ctcaggaggt tgaggctgca gtgagctatg 5101 attgcgccac tgcactcctg cctgagcgac tgagcaagat cttgtctctg aagaaaaaaa 5161 aagaaataaa aatgctgcta tcaaaatcaa gcccaaccag aggtagaaga gccaagaagc -continued

```
5221   ctgggttctc atcctagctc tgtctcttct gtctctatct ttgtgatctt ggactgtcaa

5281   ttccccttcc tgtgatccat tttactgcaa acataagggt tgcagtaaag ggttgtctca

5341   cgtcttctgc tttaaaagcc tataaatata tgacctgaaa actccagtta cataaaggat

5401   ctgcagctat ctaaggcttg gttttcttac tgtcatatga tacctgggtc taatgaactc

5461   tgctgagatc acctcaagtt tctgcggttg gtaaagagaa caagggaaga acaaacatcc

5521   cttttattgc tccaaatggt gatttaatcc ctacatggtg ctgggtggac aatgtgtcac

5581   tgtcacatgc cttcactgta taaatccaac cttctgccag agagaatctg tggttctggc

5641   catggaggga ggatagtgga aatgatatag ttggactggt gcttgatgtc actaataaat

5701   gaaactgtca gctgg
```

As defined herein, an antisense strand sequence is designed to target an XDH gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target an XDH gene at position 1322 requires that when base pairing to the gene, the 5' terminal nucleobase of the antisense strand is aligned with position 1342 of the XDH gene.

As provided herein, an XDH RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. For example, for an XDH RNAi agent disclosed herein that is designed to target position 1322 of an XDH gene, the 5' terminal nucleobase of the antisense strand of the of the XDH RNAi agent is aligned with position 1342 of the gene; however, the 5' terminal nucleobase of the antisense strand may be, but is not required to be, complementary to position 1342 of an XDH gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 16 consecutive nucleotides. As shown by, among other things, the various examples disclosed herein, the specific site of binding of the gene by the antisense strand of the XDH RNAi agent (e.g., whether the XDH RNAi agent is designed to target an XDH gene at position 238, at position 1322, at position 1963, at position 2696, at position 2995, at position 3041, at position 3016, at position 3598, at position 4289, at position 2612, or at some other position) is important to the level of inhibition achieved by the XDH RNAi agent.

In some aspects, the XDH RNAi agents disclosed herein target an XDH gene at or near the positions of the XDH gene sequence shown in Table 1. In some aspects, the antisense strand of an XDH RNAi agent disclosed herein includes a core stretch sequence that is fully, substantially, or at least partially complementary to a target XDH 19-mer sequence disclosed in Table 1.

TABLE 1

XDH 19-mer mRNA Target Sequences (taken from *homo sapiens* xanthine dehydrogenase (XDH), mRNA, GenBank NM_000379.4 (SEQ ID NO: 1))

| SEQ ID No. | XDH 19-mer Target Sequences (5'→3') | Corresponding Positions of Sequence on SEQ ID NO: 1 | Targeted Gene Position (as referred to herein) |
|---|---|---|---|
| 2 | UCAGCUUCUUCUUCAAGUU | 1614-1632 | 1612 |
| 3 | AGCUUCUUCUUCAAGUUCU | 1616-1634 | 1614 |
| 4 | UUCUUCUUCAAGUUCUACC | 1619-1637 | 1617 |
| 5 | GGGUGAAAAUCACCUAUGA | 2130-2148 | 2128 |
| 6 | GUGAAAAUCACCUAUGAAG | 2132-2150 | 2130 |
| 7 | UGAAAAUCACCUAUGAAGA | 2133-2151 | 2131 |
| 8 | GAAAAUCACCUAUGAAGAA | 2134-2152 | 2132 |
| 9 | ACCAGCCAUUAUCACAAUU | 2155-2173 | 2153 |
| 10 | AGAACAACUCCUUUUAUGG | 2187-2205 | 2185 |
| 11 | GAACAACUCCUUUUAUGGA | 2188-2206 | 2186 |
| 12 | GACAAGCACUAACACUGUG | 3274-3292 | 3272 |
| 13 | GUCAUGAGUAUGUACACAC | 437-455 | 435 |
| 14 | GACAUGCUGAUAACUGGUG | 2573-2591 | 2571 |
| 15 | AUACAAGGUUGGCUUCAUG | 2614-2632 | 2612 |
| 16 | AAGGUUGGCUUCAUGAAGA | 2618-2636 | 2616 |
| 17 | AGGUUGGCUUCAUGAAGAC | 2619-2637 | 2617 |
| 18 | GUUGGCUUCAUGAAGACUG | 2621-2639 | 2619 |
| 19 | GAGAAUUGUUGGAAAAAGA | 3047-3065 | 3045 |
| 20 | GGCUUGCUCUGAAGUAGAA | 3550-3568 | 3548 |
| 21 | UUGCUCUGAAGUAGAAAUC | 3553-3571 | 3551 |
| 22 | CUGCCAUUGAUAUUGGACA | 3642-3660 | 3640 |
| 23 | AGAUCGUCCACUUUUCUGC | 267-285 | 265 |
| 24 | CCGAAGCAGAUAAUGUUGU | 2250-2268 | 2248 |

TABLE 1-continued

XDH 19-mer mRNA Target Sequences (taken from *homo sapiens* xanthine dehydrogenase (XDH), mRNA, GenBank NM_000379.4 (SEQ ID NO: 1))

| SEQ ID No. | XDH 19-mer Target Sequences (5'→3') | Corresponding Positions of Sequence on SEQ ID NO: 1 | Targeted Gene Position (as referred to herein) |
|---|---|---|---|
| 25 | CUCUCUCAGAGUAUUAUGG | 2696-2714 | 2694 |
| 26 | CACCAAGUUUGGAAUAAGC | 3085-3103 | 3083 |
| 27 | GCAUAAAGCAAGAUUACUC | 4667-4685 | 4665 |
| 28 | CAAUGUUCUAGAUUUCUUU | 4727-4745 | 4725 |
| 29 | UGCUGGAUGAGUGAAGUUG | 2852-2870 | 2850 |
| 30 | GCUGGAUGAGUGAAGUUGC | 2853-2871 | 2851 |
| 31 | CUGGAUGAGUGAAGUUGCA | 2854-2872 | 2852 |
| 32 | UGCUCUCCAAGUAUGAUCG | 237-255 | 235 |
| 33 | GAUCGUCUGCAGAACAAGA | 251-269 | 249 |
| 34 | CGUCUGCAGAACAAGAUCG | 254-272 | 252 |
| 35 | CGCCAGUGCAACUUUACUG | 1705-1723 | 1703 |
| 36 | GAUAAGGUUACUUGUGUUG | 2051-2069 | 2049 |
| 37 | CAGCCAUUAUCACAAUUGA | 2157-2175 | 2155 |
| 38 | AGCUCUCAGUAUCAUGCUC | 2999-3017 | 2997 |
| 39 | AGAGUGAGGUUGACAAGUU | 3021-3038 | 3019 |
| 40 | GAGUGAGGUUGACAAGUUC | 3022-3040 | 3020 |
| 41 | UCAACAAGGAGAAUUGUUG | 3039-3057 | 3037 |
| 42 | AACAUACCACAGAACAUGG | 4138-4156 | 4136 |
| 43 | ACAUGGAUCUAUUAAAGUC | 4151-4169 | 4149 |
| 44 | CAUGGAUCUAUUAAAGUCA | 4152-4170 | 4150 |
| 45 | CCUAAAUGGUGAAUAUGCA | 4291-4309 | 4289 |
| 46 | ACCUCUAGAAGCUUAAACC | 4448-4466 | 4446 |
| 47 | CCUUCAAACCAAUGAACAG | 4507-4525 | 4505 |
| 48 | AAUGAACAGCAAAGCAUAA | 4517-4535 | 4515 |
| 49 | UGAACAGCAAAGCAUAACC | 4519-4537 | 4517 |
| 50 | GAACAGCAAAGCAUAACCU | 4520-4538 | 4518 |
| 51 | ACAGCAAAGCAUAACCUUG | 4522-4540 | 4520 |
| 52 | AAAGCAUAACCUUGAAUCU | 4527-4545 | 4525 |
| 53 | AACCAACUCAAUUAUUGAG | 4702-4720 | 4700 |
| 54 | UCCUGUGAUCCAUUUUACU | 5288-5306 | 5286 |
| 55 | UUUUCUUACUGUCAUAUGA | 5422-5440 | 5420 |
| 56 | GGAGAAAAAUGCAGAUCCA | 124-142 | 122 |
| 57 | CAGAGACAACCCUUUUGGC | 141-159 | 139 |
| 58 | CUCCAAGUAUGAUCGUCUG | 241-259 | 239 |
| 59 | AACUGUGGAAGGAAUAGGA | 334-352 | 332 |
| 60 | GCAUCGUCAUGAGUAUGUA | 432-450 | 430 |
| 61 | CUUCCAAGGAAAUCUGUGC | 502-520 | 500 |
| 62 | GGCAUUGAGAUGAAGUUCA | 869-887 | 867 |
| 63 | UGAAGUUCAAGAAUAUGCU | 879-897 | 877 |
| 64 | AAUAUGCUGUUUCCUAUGA | 890-908 | 888 |
| 65 | UGCUCUCCAUAGAGAUCCC | 1287-1305 | 1285 |
| 66 | GUAUUUCUCAGCAUUCAAG | 1324-1342 | 1322 |
| 67 | CCAAGAUCAAGUCCAUAGA | 1923-1941 | 1921 |
| 68 | CAGGGUUUGUUUGUUUCAU | 1965-1983 | 1963 |
| 69 | CACCUAUGAAGAACUACCA | 2140-2158 | 2138 |
| 70 | GAACUACCAGCCAUUAUCA | 2150-2168 | 2148 |
| 71 | GCCAUUAUCACAAUUGAGG | 2159-2177 | 2157 |
| 72 | AGCUGAAGAUCGAGAAAGG | 2211-2229 | 2209 |
| 73 | GCACCAUUGCUGUUCCAAA | 2322-2340 | 2320 |
| 74 | GGAGCUCUUUGUGUCUACA | 2359-2377 | 2357 |
| 75 | CUCUUUGUGUCUACACAGA | 2363-2381 | 2361 |
| 76 | CUCUCAGAGUAUUAUGGAA | 2698-2716 | 2696 |
| 77 | AGAGUAUUAUGGAACGAGC | 2703-2721 | 2701 |
| 78 | AGGGUUUGUUUGUUUCAUU | 1966-1984 | 1964 |
| 79 | GGGUUUGUUUGUUUCAUUU | 1967-1985 | 1965 |
| 80 | GUUUGUUUGUUUCAUUUCC | 1969-1987 | 1967 |
| 81 | UCUCCAAGUAUGAUCGUCU | 240-258 | 238 |
| 82 | AGGAGAUUGAGAAUGCCUU | 486-504 | 484 |
| 83 | AGAAUGCCUUCCAAGGAAA | 495-513 | 493 |
| 84 | UGCCUUCCAAGGAAAUCUG | 499-517 | 497 |
| 85 | AGAAUAUGCUGUUUCCUAU | 888-906 | 886 |
| 86 | UUGGAGGGAACAUCAUCAC | 1119-1137 | 1117 |
| 87 | GCUUCUUCUUCAAGUUCUA | 1617-1635 | 1615 |
| 88 | GUUGGGCAUAUCAUUGGUG | 2066-2084 | 2064 |
| 89 | UCUACACAGAACACCAUGA | 2372-2390 | 2370 |
| 90 | CACCCAGGAUCUCUCUCAG | 2686-2704 | 2684 |
| 91 | CAAGCUCUCAGUAUCAUGC | 2997-3015 | 2995 |

TABLE 1-continued

XDH 19-mer mRNA Target Sequences (taken from *homo sapiens* xanthine dehydrogenase (XDH), mRNA, GenBank NM_000379.4 (SEQ ID NO: 1))

| SEQ ID No. | XDH 19-mer Target Sequences (5'→3') | Corresponding Positions of Sequence on SEQ ID NO: 1 | Targeted Gene Position (as referred to herein) |
|---|---|---|---|
| 92 | GGAAGAGUGAGGUUGACAA | 3018-3036 | 3016 |
| 93 | CAAGGAGAAUUGUUGGAAA | 3043-3061 | 3041 |
| 94 | AGCUUUGAGACUAACUCAG | 3500-3518 | 3498 |
| 95 | UCCGCACAGAUAUUGUCAU | 3600-3618 | 3598 |
| 96 | CGCACAGAUAUUGUCAUGG | 3602-3620 | 3600 |
| 97 | CUGCUUCUAUCUUCUUUGC | 3879-3897 | 3877 |
| 98 | CACACAGGUAAUAACGUGA | 3932-3950 | 3930 |
| 99 | UGUAUAACCUCAAGUUCUG | 4396-4414 | 4394 |
| 100 | CCAAUGAACAGCAAAGCAU | 4515-4533 | 4513 |
| 101 | UAACCUUGAAUCUAUACUC | 4533-4551 | 4531 |
| 102 | CAUAAAGCAAGAUUACUCU | 4668-4686 | 4666 |
| 103 | CACCUAGAAAUGAUGCUAU | 4845-4863 | 4843 |
| 104 | AGCUCUGUCUCUUCUGUCU | 5236-5254 | 5234 |
| 105 | AAGGCUUGGUUUUCUUACU | 5413-5431 | 5411 |
| 106 | GUGAUGCUCUCCAAGUAUG | 233-251 | 231 |
| 107 | CAAGUAUGAUCGUCUGCAG | 244-262 | 242 |
| 108 | GCAUGAGAGUUUUAUUCAA | 1386-1404 | 1384 |
| 109 | CAAGAUCGUCCACUUUUCU | 265-283 | 263 |
| 110 | CAUGUUGCAGUGACAACUG | 320-338 | 318 |
| 111 | UGACAACUGUGGAAGGAAU | 330-348 | 328 |
| 112 | GGAGGAGAUUGAGAAUGCC | 484-502 | 482 |
| 113 | CACGGAGAUUGGCAUUGAG | 859-877 | 857 |
| 114 | AGAUGAAGUUCAAGAAUAU | 876-894 | 874 |
| 115 | GAGAUACUGCUCUCCAUAG | 1280-1298 | 1278 |
| 116 | GGAGUAUUUCUCAGCAUUC | 1321-1339 | 1319 |
| 117 | GAGUAUUUCUCAGCAUUCA | 1322-1340 | 1320 |
| 118 | GGAGAGAAGAUGACAUUGC | 1353-1371 | 1351 |
| 119 | UAACAUAACUGGAAUUUGU | 2008-2026 | 2006 |
| 120 | AGCCAUUAUCACAAUUGAG | 2158-2176 | 2156 |
| 121 | GCUUUGUUGCAAAAAUGUU | 2400-2418 | 2398 |
| 122 | UUUGUUGCAAAAAUGUUGG | 2402-2420 | 2400 |
| 123 | GAUUGUGGUUCGAGUGAAG | 2437-2455 | 2435 |
| 124 | GAUUGAGAAUGCCUUCCAA | 490-508 | 488 |

In some aspects, an XDI-I RNAi agent includes an antisense strand wherein position 19 of the antisense strand (5'→3') is capable of forming a base pair with position 1 of a 19-mer target sequence disclosed in Table 1. In some aspects, an XDH RNAi agent includes an antisense strand wherein position 1 of the antisense strand (5'→3') is capable of forming a base pair with position 19 of the 19-mer target sequence disclosed in Table 1.

In some aspects, an XDH RNAi agent includes an antisense strand wherein position 2 of the antisense strand (5'→3') is capable of forming a base pair with position 18 of the 19-mer target sequence disclosed in Table 1. In some aspects, an XDI-I RNAi agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to the XDH gene, or can be non-complementary to the XDH gene. In some aspects, the nucleotide at position 1 of the antisense strand (from 5' end→3' end) is a U, A, or dT. In some aspects, the nucleotide at position 1 of the antisense strand (from 5' end→3' end) forms an A:U or U:A base pair with the sense strand.

In some aspects, an XDH RNAi agent antisense strand comprises the sequence of nucleotides (from 5' end→3' end) at positions 2-18, 2-19, 2-20, or 2-21 of any of the antisense strand sequences in Table 2, Table 3, or Table 5C. In some aspects, an XDH RNAi sense strand comprises the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences in Table 2, Table 4, or Table 5C.

In some aspects, an XDH RNAi agent antisense strand comprises the sequence of nucleotides (from 5' end→3' end) at positions 2-18, 2-19, 2-20, or 2-21 of any of the antisense strand sequences of Table 2, Table 3, or Table 5C. In some aspects, an XDH RNAi sense strand comprises the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences of Table 2, Table 4, or Table 5C.

In some aspects, an XDH RNAi agent is comprised of (i) an antisense strand comprising the sequence of nucleotides (from 5' end→3' end) at positions 2-18 or 2-19 of any of the antisense strand sequences in Table 2 or Table 3, and (ii) a sense strand comprising the sequence of nucleotides (from 5' end→3' end) at positions 3-21, 2-21, 1-21, 3-20, 2-20, 1-20, 3-19, 2-19, 1-19, 3-18, 2-18, or 1-18 of any of the sense strand sequences in Table 2 or Table 4.

In some aspects, the XDH RNAi agents include core 19-mer nucleotide sequences shown in the following Table 2.

TABLE 2

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 125 | AACUUGAAGAAGAAGCUGA | 535 | UCAGCUUCUUCUUCAAGUU | 1614-1632 | 1612 |
| 126 | UACUUGAAGAAGAAGCUGA | 536 | UCAGCUUCUUCUUCAAGUA | 1614-1632 | 1612 |
| 127 | NACUUGAAGAAGAAGCUGA | 537 | UCAGCUUCUUCUUCAAGUN | 1614-1632 | 1612 |
| 128 | NACUUGAAGAAGAAGCUGN | 538 | NCAGCUUCUUCUUCAAGUN | 1614-1632 | 1612 |
| 129 | AGAACUUGAAGAAGAAGCU | 539 | AGCUUCUUCUUCAAGUUCU | 1616-1634 | 1614 |
| 130 | UGAACUUGAAGAAGAAGCU | 540 | AGCUUCUUCUUCAAGUUCA | 1616-1634 | 1614 |
| 131 | NGAACUUGAAGAAGAAGCU | 541 | AGCUUCUUCUUCAAGUUCN | 1616-1634 | 1614 |
| 132 | NGAACUUGAAGAAGAAGCN | 542 | NGCUUCUUCUUCAAGUUCN | 1616-1634 | 1614 |
| 133 | UGUAGAACUUGAAGAAGAA | 543 | UUCUUCUUCAAGUUCUACA | 1619-1637 | 1617 |
| 134 | NGUAGAACUUGAAGAAGAA | 544 | UUCUUCUUCAAGUUCUACN | 1619-1637 | 1617 |
| 135 | NGUAGAACUUGAAGAAGAN | 545 | NUCUUCUUCAAGUUCUACN | 1619-1637 | 1617 |
| 136 | UCAUAGGUGAUUUUCACCC | 546 | GGGUGAAAAUCACCUAUGA | 2130-2148 | 2128 |
| 137 | NCAUAGGUGAUUUUCACCC | 547 | GGGUGAAAAUCACCUAUGN | 2130-2148 | 2128 |
| 138 | NCAUAGGUGAUUUUCACCN | 548 | NGGUGAAAAUCACCUAUGN | 2130-2148 | 2128 |
| 139 | UUUCAUAGGUGAUUUUCAC | 549 | GUGAAAAUCACCUAUGAAA | 2132-2150 | 2130 |
| 140 | NUUCAUAGGUGAUUUUCAC | 550 | GUGAAAAUCACCUAUGAAN | 2132-2150 | 2130 |
| 141 | NUUCAUAGGUGAUUUUCAN | 551 | NUGAAAAUCACCUAUGAAN | 2132-2150 | 2130 |
| 142 | UCUUCAUAGGUGAUUUUCA | 552 | UGAAAAUCACCUAUGAAGA | 2133-2151 | 2131 |
| 143 | NCUUCAUAGGUGAUUUUCA | 553 | UGAAAAUCACCUAUGAAGN | 2133-2151 | 2131 |
| 144 | NCUUCAUAGGUGAUUUUCN | 554 | NGAAAAUCACCUAUGAAGN | 2133-2151 | 2131 |
| 145 | UUCUUCAUAGGUGAUUUUC | 555 | GAAAAUCACCUAUGAAGAA | 2134-2152 | 2132 |
| 146 | NUCUUCAUAGGUGAUUUUC | 556 | GAAAAUCACCUAUGAAGAN | 2134-2152 | 2132 |
| 147 | NUCUUCAUAGGUGAUUUUN | 557 | NAAAAUCACCUAUGAAGAN | 2134-2152 | 2132 |
| 148 | AAUUGUGAUAAUGGCUGGU | 558 | ACCAGCCAUUAUCACAAUU | 2155-2173 | 2153 |
| 149 | UAUUGUGAUAAUGGCUGGU | 559 | ACCAGCCAUUAUCACAAUA | 2155-2173 | 2153 |
| 150 | NAUUGUGAUAAUGGCUGGU | 560 | ACCAGCCAUUAUCACAAUN | 2155-2173 | 2153 |
| 151 | NAUUGUGAUAAUGGCUGGN | 561 | NCCAGCCAUUAUCACAAUN | 2155-2173 | 2153 |
| 152 | UCAUAAAAGGAGUUGUUCU | 562 | AGAACAACUCCUUUUAUGA | 2187-2205 | 2185 |
| 153 | NCAUAAAAGGAGUUGUUCU | 563 | AGAACAACUCCUUUUAUGN | 2187-2205 | 2185 |
| 154 | NCAUAAAAGGAGUUGUUCN | 564 | NGAACAACUCCUUUUAUGN | 2187-2205 | 2185 |
| 155 | UCCAUAAAAGGAGUUGUUC | 565 | GAACAACUCCUUUUAUGGA | 2188-2206 | 2186 |
| 156 | NCCAUAAAAGGAGUUGUUC | 566 | GAACAACUCCUUUUAUGGN | 2188-2206 | 2186 |
| 157 | NCCAUAAAAGGAGUUGUUN | 567 | NAACAACUCCUUUUAUGGN | 2188-2206 | 2186 |
| 158 | UACAGUGUUAGUGCUUGUC | 568 | GACAAGCACUAACACUGUA | 3274-3292 | 3272 |
| 159 | NACAGUGUUAGUGCUUGUC | 569 | GACAAGCACUAACACUGUN | 3274-3292 | 3272 |
| 160 | NACAGUGUUAGUGCUUGUN | 570 | NACAAGCACUAACACUGUN | 3274-3292 | 3272 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 161 | UUGUGUACAUACUCAUGAC | 571 | GUCAUGAGUAUGUACACAA | 437-455 | 435 |
| 162 | NUGUGUACAUACUCAUGAC | 572 | GUCAUGAGUAUGUACACAN | 437-455 | 435 |
| 163 | NUGUGUACAUACUCAUGAN | 573 | NUCAUGAGUAUGUACACAN | 437-455 | 435 |
| 164 | UACCAGUUAUCAGCAUGUC | 574 | GACAUGCUGAUAACUGIUA | 2573-2591 | 2571 |
| 165 | NACCAGUUAUCAGCAUGUC | 575 | GACAUGCUGAUAACUGIUN | 2573-2591 | 2571 |
| 166 | NACCAGUUAUCAGCAUGUN | 576 | NACAUGCUGAUAACUGIUN | 2573-2591 | 2571 |
| 167 | UACCAGUUAUCAGCAUGUC | 577 | GACAUGCUGAUAACUGGUA | 2573-2591 | 2571 |
| 168 | NACCAGUUAUCAGCAUGUC | 578 | GACAUGCUGAUAACUGGUA | 2573-2591 | 2571 |
| 169 | NACCAGUUAUCAGCAUGUN | 579 | GACAUGCUGAUAACUGGUA | 2573-2591 | 2571 |
| 170 | UAUGAAGCCAACCUUGUAU | 580 | AUACAAGGUUGGCUUCAUA | 2614-2632 | 2612 |
| 171 | NAUGAAGCCAACCUUGUAU | 581 | AUACAAGGUUGGCUUCAUN | 2614-2632 | 2612 |
| 172 | NAUGAAGCCAACCUUGUAN | 582 | NUACAAGGUUGGCUUCAUN | 2614-2632 | 2612 |
| 173 | UCUUCAUGAAGCCAACCUU | 583 | AAGGUUGGCUUCAUGAAGA | 2618-2636 | 2616 |
| 174 | NCUUCAUGAAGCCAACCUU | 584 | AAGGUUGGCUUCAUGAAGN | 2618-2636 | 2616 |
| 175 | NCUUCAUGAAGCCAACCUN | 585 | NAGGUUGGCUUCAUGAAGN | 2618-2636 | 2616 |
| 176 | UUCUUCAUGAAGCCAACCU | 586 | AGGUUGGCUUCAUGAAGAA | 2619-2637 | 2617 |
| 177 | NUCUUCAUGAAGCCAACCU | 587 | AGGUUGGCUUCAUGAAGAN | 2619-2637 | 2617 |
| 178 | NUCUUCAUGAAGCCAACCN | 588 | NGGUUGGCUUCAUGAAGAN | 2619-2637 | 2617 |
| 179 | UAGUCUUCAUGAAGCCAAC | 589 | GUUGGCUUCAUGAAGACUA | 2621-2639 | 2619 |
| 180 | NAGUCUUCAUGAAGCCAAC | 590 | GUUGGCUUCAUGAAGACUN | 2621-2639 | 2619 |
| 181 | NAGUCUUCAUGAAGCCAAN | 591 | NUUGGCUUCAUGAAGACUN | 2621-2639 | 2619 |
| 182 | UCUUUUUCCAACAAUUCUC | 592 | GAGAAUUGUUGGAAAAAGA | 3047-3065 | 3045 |
| 183 | NCUUUUUCCAACAAUUCUC | 593 | GAGAAUUGUUGGAAAAAGN | 3047-3065 | 3045 |
| 184 | NCUUUUUCCAACAAUUCUN | 594 | NAGAAUUGUUGGAAAAAGN | 3047-3065 | 3045 |
| 185 | UUCUACUUCAGAGCAAGCC | 595 | GGCUUGCUCUGAAGUAGAA | 3550-3568 | 3548 |
| 186 | NUCUACUUCAGAGCAAGCC | 596 | GGCUUGCUCUGAAGUAGAN | 3550-3568 | 3548 |
| 187 | NUCUACUUCAGAGCAAGCN | 597 | NGCUUGCUCUGAAGUAGAN | 3550-3568 | 3548 |
| 188 | UAUUUCUACUUCAGAGCAA | 598 | UUGCUCUGAAGUAGAAAUA | 3553-3571 | 3551 |
| 189 | NAUUUCUACUUCAGAGCAA | 599 | UUGCUCUGAAGUAGAAAUN | 3553-3571 | 3551 |
| 190 | NAUUUCUACUUCAGAGCAN | 600 | NUGCUCUGAAGUAGAAAUN | 3553-3571 | 3551 |
| 191 | UGUCCAAUAUCAAUGGCAG | 601 | CUGCCAUUGAUAUUIGACA | 3642-3660 | 3640 |
| 192 | NGUCCAAUAUCAAUGGCAG | 602 | CUGCCAUUGAUAUUIGACN | 3642-3660 | 3640 |
| 193 | NGUCCAAUAUCAAUGGCAN | 603 | NUGCCAUUGAUAUUIGACN | 3642-3660 | 3640 |
| 194 | UCAGAAAAGUGGACGAUCU | 604 | AGAUCGUCCACUUUUCUGA | 267-285 | 265 |
| 195 | NCAGAAAAGUGGACGAUCU | 605 | AGAUCGUCCACUUUUCUGN | 267-285 | 265 |
| 196 | NCAGAAAAGUGGACGAUCN | 606 | NGAUCGUCCACUUUUCUGN | 267-285 | 265 |

TABLE 2-continued

| XDH RNAi Agent Antisense Strand and Sense Strand Core Stretch Base Sequences | | | | | |
|---|---|---|---|---|---|
| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
| 197 | ACAACAUUAUCUGCUUCGG | 607 | CCGAAGCAGAUAAUGUUGU | 2250-2268 | 2248 |
| 198 | UCAACAUUAUCUGCUUCGG | 608 | CCGAAGCAGAUAAUGUUGU | 2250-2268 | 2248 |
| 199 | NCAACAUUAUCUGCUUCGG | 609 | CCGAAGCAGAUAAUGUUGN | 2250-2268 | 2248 |
| 200 | NCAACAUUAUCUGCUUCGN | 610 | NCGAAGCAGAUAAUGUUGN | 2250-2268 | 2248 |
| 201 | UCAUAAUACUCUGAGAGAG | 611 | CUCUCUCAGAGUAUUAUGA | 2696-2714 | 2694 |
| 202 | NCAUAAUACUCUGAGAGAG | 612 | CUCUCUCAGAGUAUUAUGN | 2696-2714 | 2694 |
| 203 | NCAUAAUACUCUGAGAGAN | 613 | NUCUCUCAGAGUAUUAUGN | 2696-2714 | 2694 |
| 204 | UCUUAUUCCAAACUUGGUG | 614 | CACCAAGUUUGGAAUAAGA | 3085-3103 | 3083 |
| 205 | NCUUAUUCCAAACUUGGUG | 615 | CACCAAGUUUGGAAUAAGN | 3085-3103 | 3083 |
| 206 | NCUUAUUCCAAACUUGGUN | 616 | NACCAAGUUUGGAAUAAGN | 3085-3103 | 3083 |
| 207 | UAGUAAUCUUGCUUUAUGC | 617 | GCAUAAAGCAAGAUUACUA | 4667-4685 | 4665 |
| 208 | NAGUAAUCUUGCUUUAUGC | 618 | GCAUAAAGCAAGAUUACUN | 4667-4685 | 4665 |
| 209 | NAGUAAUCUUGCUUUAUGN | 619 | NCAUAAAGCAAGAUUACUN | 4667-4685 | 4665 |
| 210 | AAAGAAAUCUAGAACAUUG | 620 | CAAUGUUCUAGAUUUCUUU | 4727-4745 | 4725 |
| 211 | UAAGAAAUCUAGAACAUUG | 621 | CAAUGUUCUAGAUUUCUUA | 4727-4745 | 4725 |
| 212 | NAAGAAAUCUAGAACAUUG | 622 | CAAUGUUCUAGAUUUCUUN | 4727-4745 | 4725 |
| 213 | NAAGAAAUCUAGAACAUUN | 623 | NAAUGUUCUAGAUUUCUUN | 4727-4745 | 4725 |
| 214 | UAACUUCACUCAUCCAGCA | 624 | UGCUGGAUGAGUGAAGUUA | 2852-2870 | 2850 |
| 215 | NAACUUCACUCAUCCAGCA | 625 | UGCUGGAUGAGUGAAGUUN | 2852-2870 | 2850 |
| 216 | NAACUUCACUCAUCCAGCN | 626 | NGCUGGAUGAGUGAAGUUN | 2852-2870 | 2850 |
| 217 | UCAACUUCACUCAUCCAGC | 627 | GCUIGAUGAGUGAAGUUGA | 2853-2871 | 2851 |
| 218 | NCAACUUCACUCAUCCAGC | 628 | GCUIGAUGAGUGAAGUUGN | 2853-2871 | 2851 |
| 219 | NCAACUUCACUCAUCCAGN | 629 | NCUIGAUGAGUGAAGUUGN | 2853-2871 | 2851 |
| 220 | UGCAACUUCACUCAUCCAG | 630 | CUGGAUGAGUGAAGUUICA | 2854-2872 | 2852 |
| 221 | NGCAACUUCACUCAUCCAG | 631 | CUGGAUGAGUGAAGUUICN | 2854-2872 | 2852 |
| 222 | NGCAACUUCACUCAUCCAN | 632 | NUGGAUGAGUGAAGUUICN | 2854-2872 | 2852 |
| 223 | UGAUCAUACUUGGAGAGCA | 633 | UGCUCUCCAAGUAUGAUCA | 237-255 | 235 |
| 224 | NGAUCAUACUUGGAGAGCA | 634 | UGCUCUCCAAGUAUGAUCN | 237-255 | 235 |
| 225 | NGAUCAUACUUGGAGAGCN | 635 | NGCUCUCCAAGUAUGAUCN | 237-255 | 235 |
| 226 | UCUUGUUCUGCAGACGAUC | 636 | GAUCGUCUGCAGAACAAGA | 251-269 | 249 |
| 227 | NCUUGUUCUGCAGACGAUC | 637 | GAUCGUCUGCAGAACAAGN | 251-269 | 249 |
| 228 | NCUUGUUCUGCAGACGAUC | 638 | GAUCGUCUGCAGAACAAGN | 251-269 | 249 |
| 229 | UGAUCUUGUUCUGCAGACG | 639 | CGUCUGCAGAACAAGAUCA | 254-272 | 252 |
| 230 | NGAUCUUGUUCUGCAGACG | 640 | CGUCUGCAGAACAAGAUCN | 254-272 | 252 |
| 231 | NGAUCUUGUUCUGCAGACN | 641 | NGUCUGCAGAACAAGAUCN | 254-272 | 252 |
| 232 | UAGUAAAGUUGCACUGGCG | 642 | CGCCAGUGCAACUUUACUA | 1705-1723 | 1703 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 233 | NAGUAAAGUUGCACUGGCG | 643 | CGCCAGUGCAACUUUACUN | 1705-1723 | 1703 |
| 234 | NAGUAAAGUUGCACUGGCN | 644 | NGCCAGUGCAACUUUACUN | 1705-1723 | 1703 |
| 235 | UAACACAAGUAACCUUAUC | 645 | GAUAAGGUUACUUGUGUUA | 2051-2069 | 2049 |
| 236 | NAACACAAGUAACCUUAUC | 646 | GAUAAGGUUACUUGUGUUN | 2051-2069 | 2049 |
| 237 | NAACACAAGUAACCUUAUN | 647 | NAUAAGGUUACUUGUGUUN | 2051-2069 | 2049 |
| 238 | UCAAUUGUGAUAAUGGCUG | 648 | CAGCCAUUAUCACAAUUGA | 2157-2175 | 2155 |
| 239 | NCAAUUGUGAUAAUGGCUG | 649 | CAGCCAUUAUCACAAUUGN | 2157-2175 | 2155 |
| 240 | NCAAUUGUGAUAAUGGCUN | 650 | NAGCCAUUAUCACAAUUGN | 2157-2175 | 2155 |
| 241 | UAGCAUGAUACUGAGAGCU | 651 | AGCUCUCAGUAUCAUGCUA | 2999-3017 | 2997 |
| 242 | NAGCAUGAUACUGAGAGCU | 652 | AGCUCUCAGUAUCAUGCUN | 2999-3017 | 2997 |
| 243 | NAGCAUGAUACUGAGAGCN | 653 | NGCUCUCAGUAUCAUGCUN | 2999-3017 | 2997 |
| 244 | AACUUGUCAACCUCACUCU | 654 | AGAGUGAGGUUGACAAGUU | 3021-3039 | 3019 |
| 245 | UACUUGUCAACCUCACUCU | 655 | AGAGUGAGGUUGACAAGUA | 3021-3039 | 3019 |
| 246 | NACUUGUCAACCUCACUCU | 656 | AGAGUGAGGUUGACAAGUN | 3021-3039 | 3019 |
| 247 | NACUUGUCAACCUCACUCN | 657 | NGAGUGAGGUUGACAAGUN | 3021-3039 | 3019 |
| 248 | UAACUUGUCAACCUCACUC | 658 | GAGUGAGGUUGACAAGUUA | 3022-3040 | 3020 |
| 249 | NAACUUGUCAACCUCACUC | 659 | GAGUGAGGUUGACAAGUUN | 3022-3040 | 3020 |
| 250 | NAACUUGUCAACCUCACUN | 660 | NAGUGAGGUUGACAAGUUN | 3022-3040 | 3020 |
| 251 | UAACAAUUCUCCUUGUUGA | 661 | UCAACAAGGAGAAUUGUUA | 3039-3057 | 3037 |
| 252 | NAACAAUUCUCCUUGUUGA | 662 | UCAACAAGGAGAAUUGUUN | 3039-3057 | 3037 |
| 253 | NAACAAUUCUCCUUGUUGN | 663 | NCAACAAGGAGAAUUGUUN | 3039-3057 | 3037 |
| 254 | UCAUGUUCUGUGGUAUGUU | 664 | AACAUACCACAGAACAUGA | 4138-4156 | 4136 |
| 255 | NCAUGUUCUGUGGUAUGUU | 665 | AACAUACCACAGAACAUGN | 4138-4156 | 4136 |
| 256 | NCAUGUUCUGUGGUAUGUN | 666 | NACAUACCACAGAACAUGN | 4138-4156 | 4136 |
| 257 | UACUUUAAUAGAUCCAUGU | 667 | ACAUGGAUCUAUUAAAGUA | 4151-4169 | 4149 |
| 258 | NACUUUAAUAGAUCCAUGU | 668 | ACAUGGAUCUAUUAAAGUN | 4151-4169 | 4149 |
| 259 | NACUUUAAUAGAUCCAUGN | 669 | NCAUGGAUCUAUUAAAGUN | 4151-4169 | 4149 |
| 260 | UGACUUUAAUAGAUCCAUG | 670 | CAUGGAUCUAUUAAAGUCA | 4152-4170 | 4150 |
| 261 | NGACUUUAAUAGAUCCAUG | 671 | CAUGGAUCUAUUAAAGUCN | 4152-4170 | 4150 |
| 262 | NGACUUUAAUAGAUCCAUN | 672 | NAUGGAUCUAUUAAAGUCN | 4152-4170 | 4150 |
| 263 | UGCAUAUUCACCAUUUAGG | 673 | CCUAAAUGGUGAAUAUGCA | 4291-4309 | 4289 |
| 264 | NGCAUAUUCACCAUUUAGG | 674 | CCUAAAUGGUGAAUAUGCN | 4291-4309 | 4289 |
| 265 | NGCAUAUUCACCAUUUAGN | 675 | NCUAAAUGGUGAAUAUGCN | 4291-4309 | 4289 |
| 266 | UGUUUAAGCUUCUAGAGGU | 676 | ACCUCUAGAAGCUUAAACA | 4448-4466 | 4446 |
| 267 | NGUUUAAGCUUCUAGAGGU | 677 | ACCUCUAGAAGCUUAAACN | 4448-4466 | 4446 |
| 268 | NGUUUAAGCUUCUAGAGGN | 678 | NCCUCUAGAAGCUUAAACN | 4448-4466 | 4446 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 269 | UUGUUCAUUGGUUUGAAGG | 679 | CCUUCAAACCAAUGAACAA | 4507-4525 | 4505 |
| 270 | NUGUUCAUUGGUUUGAAGG | 680 | CCUUCAAACCAAUGAACAN | 4507-4525 | 4505 |
| 271 | NUGUUCAUUGGUUUGAAGN | 681 | NCUUCAAACCAAUGAACAN | 4507-4525 | 4505 |
| 272 | UUAUGCUUUGCUGUUCAUU | 682 | AAUGAACAGCAAAGCAUAA | 4517-4535 | 4515 |
| 273 | NUAUGCUUUGCUGUUCAUU | 683 | AAUGAACAGCAAAGCAUAN | 4517-4535 | 4515 |
| 274 | NUAUGCUUUGCUGUUCAUN | 684 | NAUGAACAGCAAAGCAUAN | 4517-4535 | 4515 |
| 275 | UGUUAUGCUUUGCUGUUCA | 685 | UGAACAGCAAAGCAUAACA | 4519-4537 | 4517 |
| 276 | NGUUAUGCUUUGCUGUUCA | 686 | UGAACAGCAAAGCAUAACN | 4519-4537 | 4517 |
| 277 | NGUUAUGCUUUGCUGUUCN | 687 | NGAACAGCAAAGCAUAACN | 4519-4537 | 4517 |
| 278 | AGGUUAUGCUUUGCUGUUC | 688 | GAACAGCAAAGCAUAACCU | 4520-4538 | 4518 |
| 279 | UGGUUAUGCUUUGCUGUUC | 689 | GAACAGCAAAGCAUAACCA | 4520-4538 | 4518 |
| 280 | NGGUUAUGCUUUGCUGUUC | 690 | GAACAGCAAAGCAUAACCN | 4520-4538 | 4518 |
| 281 | NGGUUAUGCUUUGCUGUUN | 691 | NAACAGCAAAGCAUAACCN | 4520-4538 | 4518 |
| 282 | UAAGGUUAUGCUUUGCUGU | 692 | ACAGCAAAGCAUAACCUUA | 4522-4540 | 4520 |
| 283 | NAAGGUUAUGCUUUGCUGU | 693 | ACAGCAAAGCAUAACCUUN | 4522-4540 | 4520 |
| 284 | NAAGGUUAUGCUUUGCUGN | 694 | NCAGCAAAGCAUAACCUUN | 4522-4540 | 4520 |
| 285 | AGAUUCAAGGUUAUGCUUU | 695 | AAAGCAUAACCUUGAAUCU | 4527-4545 | 4525 |
| 286 | UGAUUCAAGGUUAUGCUUU | 696 | AAAGCAUAACCUUGAAUCA | 4527-4545 | 4525 |
| 287 | NGAUUCAAGGUUAUGCUUU | 697 | AAAGCAUAACCUUGAAUCN | 4527-4545 | 4525 |
| 288 | NGAUUCAAGGUUAUGCUUN | 698 | NAAGCAUAACCUUGAAUCN | 4527-4545 | 4525 |
| 289 | UUCAAUAAUUGAGUUGGUU | 699 | AACCAACUCAAUUAUUGAA | 4702-4720 | 4700 |
| 290 | NUCAAUAAUUGAGUUGGUU | 700 | AACCAACUCAAUUAUUGAN | 4702-4720 | 4700 |
| 291 | NUCAAUAAUUGAGUUGGUN | 701 | NACCAACUCAAUUAUUGAN | 4702-4720 | 4700 |
| 292 | AGUAAAAUGGAUCACAGGA | 702 | UCCUGUGAUCCAUUUUACU | 5288-5306 | 5286 |
| 293 | UGUAAAAUGGAUCACAGGA | 703 | UCCUGUGAUCCAUUUUACA | 5288-5306 | 5286 |
| 294 | NGUAAAAUGGAUCACAGGA | 704 | UCCUGUGAUCCAUUUUACN | 5288-5306 | 5286 |
| 295 | NGUAAAAUGGAUCACAGGN | 705 | NCCUGUGAUCCAUUUUACN | 5288-5306 | 5286 |
| 296 | UCAUAUGACAGUAAGAAAA | 706 | UUUUCUUACUGUCAUAUGA | 5422-5440 | 5420 |
| 297 | NCAUAUGACAGUAAGAAAA | 707 | UUUUCUUACUGUCAUAUGN | 5422-5440 | 5420 |
| 298 | NCAUAUGACAGUAAGAAAN | 708 | NUUUCUUACUGUCAUAUGN | 5422-5440 | 5420 |
| 299 | UGGAUCUGCAUUUUUCUCC | 709 | GGAGAAAAAUGCAIAUCCA | 124-142 | 122 |
| 300 | NGGAUCUGCAUUUUUCUCC | 710 | GGAGAAAAAUGCAIAUCCN | 124-142 | 122 |
| 301 | NGGAUCUGCAUUUUUCUCN | 711 | NGAGAAAAAUGCAIAUCCN | 124-142 | 122 |
| 302 | UCCAAAAGGGUUGUCUCUG | 712 | CAGAGACAACUCUUUUGGA | 141-159 | 139 |
| 303 | NCCAAAAGGGUUGUCUCUG | 713 | CAGAGACAACUCUUUUGGN | 141-159 | 139 |
| 304 | NCCAAAAGGGUUGUCUCUN | 714 | NAGAGACAACUCUUUUGGN | 141-159 | 139 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 305 | UAGACGAUCAUACUUGGAG | 715 | CUCCAAGUAUGAUCIUCUA | 241-259 | 239 |
| 306 | NAGACGAUCAUACUUGGAG | 716 | CUCCAAGUAUGAUCIUCUN | 241-259 | 239 |
| 307 | NAGACGAUCAUACUUGGAN | 717 | NUCCAAGUAUGAUCIUCUN | 241-259 | 239 |
| 308 | UCCUAUUCCUUCCACAGUU | 718 | AACUGUGGAAGGAAUAGGA | 334-352 | 332 |
| 309 | NCCUAUUCCUUCCACAGUU | 719 | AACUGUGGAAGGAAUAGGN | 334-352 | 332 |
| 310 | NCCUAUUCCUUCCACAGUN | 720 | NACUGUGGAAGGAAUAGGN | 334-352 | 332 |
| 311 | UACAUACUCAUGACGAUGC | 721 | GCAUCGUCAUGAGUAUGUA | 432-450 | 430 |
| 312 | NACAUACUCAUGACGAUGC | 722 | GCAUCGUCAUGAGUAUGUN | 432-450 | 430 |
| 313 | NACAUACUCAUGACGAUGN | 723 | NCAUCGUCAUGAGUAUGUN | 432-450 | 430 |
| 314 | UCACAGAUUUCCUUGGAAG | 724 | CUUCCAAGGAAAUCUGUIA | 502-520 | 500 |
| 315 | NCACAGAUUUCCUUGGAAG | 725 | CUUCCAAGGAAAUCUGUIN | 502-520 | 500 |
| 316 | NCACAGAUUUCCUUGGAAN | 726 | NUUCCAAGGAAAUCUGUIN | 502-520 | 500 |
| 317 | UGAACUUCAUCUCAAUGCC | 727 | GGCAUUGAGAUGAAGUUCA | 869-887 | 867 |
| 318 | NGAACUUCAUCUCAAUGCC | 728 | GGCAUUGAGAUGAAGUUCN | 869-887 | 867 |
| 319 | NGAACUUCAUCUCAAUGCN | 729 | NGCAUUGAGAUGAAGUUCN | 869-887 | 867 |
| 320 | AGCAUAUUCUUGAACUUCA | 730 | UGAAGUUCAAGAAUAUGCU | 879-897 | 877 |
| 321 | UGCAUAUUCUUGAACUUCA | 731 | UGAAGUUCAAGAAUAUGCA | 879-897 | 877 |
| 322 | NGCAUAUUCUUGAACUUCA | 732 | UGAAGUUCAAGAAUAUGCN | 879-897 | 877 |
| 323 | NGCAUAUUCUUGAACUUCN | 733 | NGAAGUUCAAGAAUAUGCN | 879-897 | 877 |
| 324 | UCAUAGGAAACAGCAUAUU | 734 | AAUAUGCUGUUUCCUAUGA | 890-908 | 888 |
| 325 | NCAUAGGAAACAGCAUAUU | 735 | AAUAUGCUGUUUCCUAUGN | 890-908 | 888 |
| 326 | NCAUAGGAAACAGCAUAUN | 736 | NAUAUGCUGUUUCCUAUGN | 890-908 | 888 |
| 327 | UGGAUCUCUAUGGAGAGCA | 737 | UGCUCUCCAUAGAIAUCCA | 1287-1305 | 1285 |
| 328 | NGGAUCUCUAUGGAGAGCA | 738 | UGCUCUCCAUAGAIAUCCN | 1287-1305 | 1285 |
| 329 | NGGAUCUCUAUGGAGAGCN | 739 | NGCUCUCCAUAGAIAUCCN | 1287-1305 | 1285 |
| 330 | UUUGAAUGCUGAGAAAUAC | 740 | GUAUUUCUCAGCAUUCAAA | 1324-1342 | 1322 |
| 331 | NUUGAAUGCUGAGAAAUAC | 741 | GUAUUUCUCAGCAUUCAAN | 1324-1342 | 1322 |
| 332 | NUUGAAUGCUGAGAAAUAN | 742 | NUAUUUCUCAGCAUUCAAN | 1324-1342 | 1322 |
| 333 | UCUAUGGACUUGAUCUUGG | 743 | CCAAGAUCAAGUCCAUAGA | 1923-1941 | 1921 |
| 334 | NCUAUGGACUUGAUCUUGG | 744 | CCAAGAUCAAGUCCAUAGN | 1923-1941 | 1921 |
| 335 | NCUAUGGACUUGAUCUUGN | 745 | NCAAGAUCAAGUCCAUAGN | 1923-1941 | 1921 |
| 336 | AUGAAACAAACAAACCCUG | 746 | CAGGGUUUGUUUGUUUCAU | 1965-1983 | 1963 |
| 337 | UUGAAACAAACAAACCCUG | 747 | CAGGGUUUGUUUGUUUCAA | 1965-1983 | 1963 |
| 338 | NUGAAACAAACAAACCCUG | 748 | CAGGGUUUGUUUGUUUCAN | 1965-1983 | 1963 |
| 339 | NUGAAACAAACAAACCCUN | 749 | NAGGGUUUGUUUGUUUCAN | 1965-1983 | 1963 |
| 340 | UGGUAGUUCUUCAUAGGUG | 750 | CACCUAUGAAGAACUACCA | 2140-2158 | 2138 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 341 | NGGUAGUUCUUCAUAGGUG | 751 | CACCUAUGAAGAACUACCN | 2140-2158 | 2138 |
| 342 | NGGUAGUUCUUCAUAGGUN | 752 | NACCUAUGAAGAACUACCN | 2140-2158 | 2138 |
| 343 | UGAUAAUGGCUGGUAGUUC | 753 | GAACUACCAGCCAUUAUCA | 2150-2168 | 2148 |
| 344 | NGAUAAUGGCUGGUAGUUC | 754 | GAACUACCAGCCAUUAUCN | 2150-2168 | 2148 |
| 345 | NGAUAAUGGCUGGUAGUUN | 755 | NAACUACCAGCCAUUAUCN | 2150-2168 | 2148 |
| 346 | UCUCAAUUGUGAUAAUGGC | 756 | GCCAUUAUCACAAUUGAGA | 2159-2177 | 2157 |
| 347 | NCUCAAUUGUGAUAAUGGC | 757 | GCCAUUAUCACAAUUGAGN | 2159-2177 | 2157 |
| 348 | NCUCAAUUGUGAUAAUGGN | 758 | NCCAUUAUCACAAUUGAGN | 2159-2177 | 2157 |
| 349 | UCUUUCUCGAUCUUCAGCU | 759 | AGCUGAAGAUCGAGAAAGA | 2211-2229 | 2209 |
| 350 | NCUUUCUCGAUCUUCAGCU | 760 | AGCUGAAGAUCGAGAAAGN | 2211-2229 | 2209 |
| 351 | NCUUUCUCGAUCUUCAGCN | 761 | NGCUGAAGAUCGAGAAAGN | 2211-2229 | 2209 |
| 352 | UUUGGAACAGCAAUGGUGC | 762 | GCACCAUUGCUGUUCCAAA | 2322-2340 | 2320 |
| 353 | NUUGGAACAGCAAUGGUGC | 763 | GCACCAUUGCUGUUCCAAN | 2322-2340 | 2320 |
| 354 | NUUGGAACAGCAAUGGUGN | 764 | NCACCAUUGCUGUUCCAAN | 2322-2340 | 2320 |
| 355 | UGUAGACACAAAGAGCUCC | 765 | GGAGCUCUUUGUGUUUACA | 2359-2377 | 2357 |
| 356 | NGUAGACACAAAGAGCUCC | 766 | GGAGCUCUUUGUGUUUACN | 2359-2377 | 2357 |
| 357 | NGUAGACACAAAGAGCUCN | 767 | NGAGCUCUUUGUGUUUACN | 2359-2377 | 2357 |
| 358 | UCUGUGUAGACACAAAGAG | 768 | CUCUUUGUGUCUACACAIA | 2363-2381 | 2361 |
| 359 | NCUGUGUAGACACAAAGAG | 769 | CUCUUUGUGUCUACACAIN | 2363-2381 | 2361 |
| 360 | NCUGUGUAGACACAAAGAN | 770 | NUCUUUGUGUCUACACAIN | 2363-2381 | 2361 |
| 361 | UUCCAUAAUACUCUGAGAG | 771 | CUCUCAGAGUAUUAUGGAA | 2698-2716 | 2696 |
| 362 | NUCCAUAAUACUCUGAGAG | 772 | CUCUCAGAGUAUUAUGGAN | 2698-2716 | 2696 |
| 363 | NUCCAUAAUACUCUGAGAN | 773 | NUCUCAGAGUAUUAUGGAN | 2698-2716 | 2696 |
| 364 | UCUCGUUCCAUAAUACUCU | 774 | AGAGUAUUAUGGAACGAIA | 2703-2721 | 2701 |
| 365 | NCUCGUUCCAUAAUACUCU | 775 | AGAGUAUUAUGGAACGAIN | 2703-2721 | 2701 |
| 366 | NCUCGUUCCAUAAUACUCN | 776 | NGAGUAUUAUGGAACGAIN | 2703-2721 | 2701 |
| 367 | AAUGAAACAAACAAACCCU | 777 | AGGGUUUGUUUGUUUCAUU | 1966-1984 | 1964 |
| 368 | UAUGAAACAAACAAACCCU | 778 | AGGGUUUGUUUGUUUCAUA | 1966-1984 | 1964 |
| 369 | NAUGAAACAAACAAACCCU | 779 | AGGGUUUGUUUGUUUCAUN | 1966-1984 | 1964 |
| 370 | NAUGAAACAAACAAACCCN | 780 | NGGGUUUGUUUGUUUCAUN | 1966-1984 | 1964 |
| 371 | AAAUGAAACAAACAAACCC | 781 | GGGUUUGUUUGUUUCAUUU | 1967-1985 | 1965 |
| 372 | UAAUGAAACAAACAAACCC | 782 | GGGUUUGUUUGUUUCAUUA | 1967-1985 | 1965 |
| 373 | NAAUGAAACAAACAAACCC | 783 | GGGUUUGUUUGUUUCAUUN | 1967-1985 | 1965 |
| 374 | NAAUGAAACAAACAAACCN | 784 | NGGUUUGUUUGUUUCAUUN | 1967-1985 | 1965 |
| 375 | UGAAAUGAAACAAACAAAC | 785 | GUUUGUUUGUUUCAUUUCA | 1969-1987 | 1967 |
| 376 | NGAAAUGAAACAAACAAAC | 786 | GUUUGUUUGUUUCAUUUCN | 1969-1987 | 1967 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 377 | NGAAAUGAAACAAACAAAN | 787 | NUUUGUUUGUUUCAUUUCN | 1969-1987 | 1967 |
| 378 | AGACGAUCAUACUUGGAGA | 788 | UCUCCAAGUAUGAUCIUCU | 240-258 | 238 |
| 379 | UGACGAUCAUACUUGGAGA | 789 | UCUCCAAGUAUGAUCIUCA | 240-258 | 238 |
| 380 | NGACGAUCAUACUUGGAGA | 790 | UCUCCAAGUAUGAUCIUCN | 240-258 | 238 |
| 381 | NGACGAUCAUACUUGGAGN | 791 | NCUCCAAGUAUGAUCIUCN | 240-258 | 238 |
| 382 | AAGGCAUUCUCAAUCUCCU | 792 | AGGAGAUUGAGAAUICCUU | 486-504 | 484 |
| 383 | UAGGCAUUCUCAAUCUCCU | 793 | AGGAGAUUGAGAAUICCUA | 486-504 | 484 |
| 384 | NAGGCAUUCUCAAUCUCCU | 794 | AGGAGAUUGAGAAUICCUN | 486-504 | 484 |
| 385 | NAGGCAUUCUCAAUCUCCN | 795 | NGGAGAUUGAGAAUICCUN | 486-504 | 484 |
| 386 | UUUCCUUGGAAGGCAUUCU | 796 | AGAAUGCCUUCCAAGGAAA | 495-513 | 493 |
| 387 | NUUCCUUGGAAGGCAUUCU | 797 | AGAAUGCCUUCCAAGGAAN | 495-513 | 493 |
| 388 | NUUCCUUGGAAGGCAUUCN | 798 | NGAAUGCCUUCCAAGGAAN | 495-513 | 493 |
| 389 | UAGAUUUCCUUGGAAGGCA | 799 | UGCCUUCCAAGGAAAUCUA | 499-517 | 497 |
| 390 | NAGAUUUCCUUGGAAGGCA | 800 | UGCCUUCCAAGGAAAUCUN | 499-517 | 497 |
| 391 | NAGAUUUCCUUGGAAGGCN | 801 | NGCCUUCCAAGGAAAUCUN | 499-517 | 497 |
| 392 | AUAGGAAACAGCAUAUUCU | 802 | AGAAUAUGCUGUUUCCUAU | 888-906 | 886 |
| 393 | UUAGGAAACAGCAUAUUCU | 803 | AGAAUAUGCUGUUUCCUAA | 888-906 | 886 |
| 394 | NUAGGAAACAGCAUAUUCU | 804 | AGAAUAUGCUGUUUCCUAN | 888-906 | 886 |
| 395 | NUAGGAAACAGCAUAUUCN | 805 | NGAAUAUGCUGUUUCCUAN | 888-906 | 886 |
| 396 | UUGAUGAUGUUCCCUCCAA | 806 | UUGGAGGGAACAUCAUCAA | 1119-1137 | 1117 |
| 397 | NUGAUGAUGUUCCCUCCAA | 807 | UUGGAGGGAACAUCAUCAN | 1119-1137 | 1117 |
| 398 | NUGAUGAUGUUCCCUCCAN | 808 | NUGGAGGGAACAUCAUCAN | 1119-1137 | 1117 |
| 399 | UAGAACUUGAAGAAGAAGC | 809 | GCUUCUUCUUCAAGUUCUA | 1617-1635 | 1615 |
| 400 | NAGAACUUGAAGAAGAAGC | 810 | GCUUCUUCUUCAAGUUCUN | 1617-1635 | 1615 |
| 401 | NAGAACUUGAAGAAGAAGN | 811 | NCUUCUUCUUCAAGUUCUN | 1617-1635 | 1615 |
| 402 | UACCAAUGAUAUGCCCAAC | 812 | GUUGGGCAUAUCAUUGGUA | 2066-2084 | 2064 |
| 403 | NACCAAUGAUAUGCCCAAC | 813 | GUUGGGCAUAUCAUUGGUN | 2066-2084 | 2064 |
| 404 | NACCAAUGAUAUGCCCAAN | 814 | NUUGGGCAUAUCAUUGGUN | 2066-2084 | 2064 |
| 405 | UCAUGGUGUUCUGUGUAGA | 815 | UCUACACAGAACACCAUGA | 2372-2390 | 2370 |
| 406 | NCAUGGUGUUCUGUGUAGA | 816 | UCUACACAGAACACCAUGN | 2372-2390 | 2370 |
| 407 | NCAUGGUGUUCUGUGUAGN | 817 | NCUACACAGAACACCAUGN | 2372-2390 | 2370 |
| 408 | UUGAGAGAGAUCCUGGGUG | 818 | CACCCAGGAUCUCUUUCAA | 2686-2704 | 2684 |
| 409 | NUGAGAGAGAUCCUGGGUG | 819 | CACCCAGGAUCUCUUUCAN | 2686-2704 | 2684 |
| 410 | NUGAGAGAGAUCCUGGGUN | 820 | NACCCAGGAUCUCUUUCAN | 2686-2704 | 2684 |
| 411 | UCAUGAUACUGAGAGCUUG | 821 | CAAGCUCUCAGUAUCAUGA | 2997-3015 | 2995 |
| 412 | NCAUGAUACUGAGAGCUUG | 822 | CAAGCUCUCAGUAUCAUGN | 2997-3015 | 2995 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 413 | NCAUGAUACUGAGAGCUUN | 823 | NAAGCUCUCAGUAUCAUGN | 2997-3015 | 2995 |
| 414 | UUGUCAACCUCACUCUUCC | 824 | GGAAGAGUGAGGUUGACAA | 3018-3036 | 3016 |
| 415 | NUGUCAACCUCACUCUUCC | 825 | GGAAGAGUGAGGUUGACAN | 3018-3036 | 3016 |
| 416 | NUGUCAACCUCACUCUUCN | 826 | NGAAGAGUGAGGUUGACAN | 3018-3036 | 3016 |
| 417 | UUUCCAACAAUUCUCCUUG | 827 | CAAGGAGAAUUGUUGGAAA | 3043-3061 | 3041 |
| 418 | NUUCCAACAAUUCUCCUUG | 828 | CAAGGAGAAUUGUUGGAAN | 3043-3061 | 3041 |
| 419 | NUUCCAACAAUUCUCCUUN | 829 | NAAGGAGAAUUGUUGGAAN | 3043-3061 | 3041 |
| 420 | UUGAGUUAGUCUCAAAGCU | 830 | AGCUUUGAGACUAACUCAA | 3500-3518 | 3498 |
| 421 | NUGAGUUAGUCUCAAAGCU | 831 | AGCUUUGAGACUAACUCAN | 3500-3518 | 3498 |
| 422 | NUGAGUUAGUCUCAAAGCN | 832 | NGCUUUGAGACUAACUCAN | 3500-3518 | 3498 |
| 423 | AUGACAAUAUCUGUGCGGA | 833 | UCCGCACAGAUAUUGUCAU | 3600-3618 | 3598 |
| 424 | UUGACAAUAUCUGUGCGGA | 834 | UCCGCACAGAUAUUGUCAA | 3600-3618 | 3598 |
| 425 | NUGACAAUAUCUGUGCGGA | 835 | UCCGCACAGAUAUUGUCAN | 3600-3618 | 3598 |
| 426 | NUGACAAUAUCUGUGCGGN | 836 | NCCGCACAGAUAUUGUCAN | 3600-3618 | 3598 |
| 427 | UCAUGACAAUAUCUGUGCG | 837 | CGCACAGAUAUUGUCAUGA | 3602-3620 | 3600 |
| 428 | NCAUGACAAUAUCUGUGCG | 838 | CGCACAGAUAUUGUCAUGN | 3602-3620 | 3600 |
| 429 | NCAUGACAAUAUCUGUGCN | 839 | NGCACAGAUAUUGUCAUGN | 3602-3620 | 3600 |
| 430 | UCAAAGAAGAUAGAAGCAG | 840 | CUGCUUCUAUCUUCUUUGA | 3879-3897 | 3877 |
| 431 | NCAAAGAAGAUAGAAGCAG | 841 | CUGCUUCUAUCUUCUUUGN | 3879-3897 | 3877 |
| 432 | NCAAAGAAGAUAGAAGCAN | 842 | NUGCUUCUAUCUUCUUUGN | 3879-3897 | 3877 |
| 433 | UCACGUUAUUACCUGUGUG | 843 | CACACAGGUAAUAACGUIA | 3932-3950 | 3930 |
| 434 | NCACGUUAUUACCUGUGUG | 844 | CACACAGGUAAUAACGUIN | 3932-3950 | 3930 |
| 435 | NCACGUUAUUACCUGUGUN | 845 | NACACAGGUAAUAACGUIN | 3932-3950 | 3930 |
| 436 | UAGAACUUGAGGUUAUACA | 846 | UGUAUAACCUCAAGUUCUA | 4396-4414 | 4394 |
| 437 | NAGAACUUGAGGUUAUACA | 847 | UGUAUAACCUCAAGUUCUN | 4396-4414 | 4394 |
| 438 | NAGAACUUGAGGUUAUACN | 848 | NGUAUAACCUCAAGUUCUN | 4396-4414 | 4394 |
| 439 | AUGCUUUGCUGUUCAUUGG | 849 | CCAAUGAACAGCAAAGCAU | 4515-4533 | 4513 |
| 440 | UUGCUUUGCUGUUCAUUGG | 850 | CCAAUGAACAGCAAAGCAA | 4515-4533 | 4513 |
| 441 | NUGCUUUGCUGUUCAUUGG | 851 | CCAAUGAACAGCAAAGCAN | 4515-4533 | 4513 |
| 442 | NUGCUUUGCUGUUCAUUGN | 852 | NCAAUGAACAGCAAAGCAN | 4515-4533 | 4513 |
| 443 | UAGUAUAGAUUCAAGGUUA | 853 | UAACCUUGAAUCUAUACUA | 4533-4551 | 4531 |
| 444 | NAGUAUAGAUUCAAGGUUA | 854 | UAACCUUGAAUCUAUACUN | 4533-4551 | 4531 |
| 445 | NAGUAUAGAUUCAAGGUUN | 855 | NAACCUUGAAUCUAUACUN | 4533-4551 | 4531 |
| 446 | AGAGUAAUCUUGCUUUAUG | 856 | CAUAAAGCAAGAUUACUCU | 4668-4686 | 4666 |
| 447 | UGAGUAAUCUUGCUUUAUG | 857 | CAUAAAGCAAGAUUACUCA | 4668-4686 | 4666 |
| 448 | NGAGUAAUCUUGCUUUAUG | 858 | CAUAAAGCAAGAUUACUCN | 4668-4686 | 4666 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 449 | NGAGUAAUCUUGCUUUAUN | 859 | NAUAAAGCAAGAUUACUCN | 4668-4686 | 4666 |
| 450 | AUAGCAUCAUUUCUAGGUG | 860 | CACCUAGAAAUGAUGCUAU | 4845-4863 | 4843 |
| 451 | UUAGCAUCAUUUCUAGGUG | 861 | CACCUAGAAAUGAUGCUAA | 4845-4863 | 4843 |
| 452 | NUAGCAUCAUUUCUAGGUG | 862 | CACCUAGAAAUGAUGCUAN | 4845-4863 | 4843 |
| 453 | NUAGCAUCAUUUCUAGGUN | 863 | NACCUAGAAAUGAUGCUAN | 4845-4863 | 4843 |
| 454 | AGACAGAAGAGACAGAGCU | 864 | AGCUCUGUCUCUUCUIUCU | 5236-5254 | 5234 |
| 455 | UGACAGAAGAGACAGAGCU | 865 | AGCUCUGUCUCUUCUIUCA | 5236-5254 | 5234 |
| 456 | NGACAGAAGAGACAGAGCU | 866 | AGCUCUGUCUCUUCUIUCN | 5236-5254 | 5234 |
| 457 | NGACAGAAGAGACAGAGCN | 867 | NGCUCUGUCUCUUCUIUCN | 5236-5254 | 5234 |
| 458 | AGUAAGAAAACCAAGCCUU | 868 | $(A^{2N})$ AGGCUUGGUUUUCUUACU | 5413-5431 | 5411 |
| 459 | UGUAAGAAAACCAAGCCUU | 869 | $(A^{2N})$ AGGCUUGGUUUUCUUACA | 5413-5431 | 5411 |
| 460 | NGUAAGAAAACCAAGCCUU | 870 | $(A^{2N})$ AGGCUUGGUUUUCUUACN | 5413-5431 | 5411 |
| 461 | NGUAAGAAAACCAAGCCUN | 871 | NAGGCUUGGUUUUCUUACN | 5413-5431 | 5411 |
| 462 | AGUAAGAAAACCAAGCCUU | 872 | AAGGCUUGGUUUUCUUACU | 5413-5431 | 5411 |
| 463 | UGUAAGAAAACCAAGCCUU | 873 | AAGGCUUGGUUUUCUUACA | 5413-5431 | 5411 |
| 464 | NGUAAGAAAACCAAGCCUU | 874 | AAGGCUUGGUUUUCUUACN | 5413-5431 | 5411 |
| 465 | NGUAAGAAAACCAAGCCUN | 875 | NAGGCUUGGUUUUCUUACN | 5413-5431 | 5411 |
| 466 | UAUACUUGGAGAGCAUCAC | 876 | GUGAUGCUCUCCAAGUAUA | 233-251 | 231 |
| 467 | NAUACUUGGAGAGCAUCAC | 877 | GUGAUGCUCUCCAAGUAUN | 233-251 | 231 |
| 468 | NAUACUUGGAGAGCAUCAN | 878 | NUGAUGCUCUCCAAGUAUN | 233-251 | 231 |
| 469 | UUGCAGACGAUCAUACUUG | 879 | CAAGUAUGAUCGUCUICAA | 244-262 | 242 |
| 470 | NUGCAGACGAUCAUACUUG | 880 | CAAGUAUGAUCGUCUICAN | 244-262 | 242 |
| 471 | NUGCAGACGAUCAUACUUN | 881 | NAAGUAUGAUCGUCUICAN | 244-262 | 242 |
| 472 | UUGAAUAAAACUCUCAUGC | 882 | GCAUGAGAGUUUUAUUCAA | 1386-1404 | 1384 |
| 473 | NUGAAUAAAACUCUCAUGC | 883 | GCAUGAGAGUUUUAUUCAN | 1386-1404 | 1384 |
| 474 | NUGAAUAAAACUCUCAUGN | 884 | NCAUGAGAGUUUUAUUCAN | 1386-1404 | 1384 |
| 475 | UUGAAUAAAACUCUCAUGC | 885 | GCAUGAGAGUUUU $(A^{2N})$ UUCAA | 1386-1404 | 1384 |
| 476 | NUGAAUAAAACUCUCAUGC | 886 | GCAUGAGAGUUUU $(A^{2N})$ UUCAN | 1386-1404 | 1384 |
| 477 | NUGAAUAAAACUCUCAUGN | 887 | NCAUGAGAGUUUU $(A^{2N})$ UUCAN | 1386-1404 | 1384 |
| 478 | AGAAAAGUGGACGAUCUUG | 888 | CAAGAUCGUCCACUUUUCU | 265-283 | 263 |
| 479 | UGAAAAGUGGACGAUCUUG | 889 | CAAGAUCGUCCACUUUUCU | 265-283 | 263 |
| 480 | NGAAAAGUGGACGAUCUUG | 890 | CAAGAUCGUCCACUUUUCN | 265-283 | 263 |
| 481 | NGAAAAGUGGACGAUCUUN | 891 | NAAGAUCGUCCACUUUUCN | 265-283 | 263 |
| 482 | UAGUUGUCACUGCAACAUG | 892 | CAUGUUGCAGUGACAACUA | 320-338 | 318 |
| 483 | NAGUUGUCACUGCAACAUG | 893 | CAUGUUGCAGUGACAACUN | 320-338 | 318 |
| 484 | NAGUUGUCACUGCAACAUN | 894 | NAUGUUGCAGUGACAACUN | 320-338 | 318 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 485 | AUUCCUUCCACAGUUGUCA | 895 | UGACAACUGUGGAAGGAAU | 330-348 | 328 |
| 486 | UUUCCUUCCACAGUUGUCA | 896 | UGACAACUGUGGAAGGAAA | 330-348 | 328 |
| 487 | NUUCCUUCCACAGUUGUCA | 897 | UGACAACUGUGGAAGGAAN | 330-348 | 328 |
| 488 | NUUCCUUCCACAGUUGUCN | 898 | NGACAACUGUGGAAGGAAN | 330-348 | 328 |
| 489 | UGCAUUCUCAAUCUCCUCC | 899 | GGAGGAGAUUGAGAAUGCA | 484-502 | 482 |
| 490 | NGCAUUCUCAAUCUCCUCC | 900 | GGAGGAGAUUGAGAAUGCN | 484-502 | 482 |
| 491 | NGCAUUCUCAAUCUCCUCN | 901 | NGAGGAGAUUGAGAAUGCN | 484-502 | 482 |
| 492 | UUCAAUGCCAAUCUCCGUG | 902 | CACGGAGAUUGGCAUUGAA | 859-877 | 857 |
| 493 | NUCAAUGCCAAUCUCCGUG | 903 | CACGGAGAUUGGCAUUGAN | 859-877 | 857 |
| 494 | NUCAAUGCCAAUCUCCGUN | 904 | NACGGAGAUUGGCAUUGAN | 859-877 | 857 |
| 495 | AUAUUCUUGAACUUCAUCU | 905 | AGAUGAAGUUCAAGAAU($A^{2N}$)U | 876-894 | 874 |
| 496 | UUAUUCUUGAACUUCAUCU | 906 | AGAUGAAGUUCAAGAAU($A^{2N}$)A | 876-894 | 874 |
| 497 | NUAUUCUUGAACUUCAUCU | 907 | AGAUGAAGUUCAAGAAU($A^{2N}$)N | 876-894 | 874 |
| 498 | NUAUUCUUGAACUUCAUCN | 908 | NGAUGAAGUUCAAGAAU($A^{2N}$)N | 876-894 | 874 |
| 499 | AUAUUCUUGAACUUCAUCU | 909 | AGAUGAAGUUCAAGAAUAU | 876-894 | 874 |
| 500 | UUAUUCUUGAACUUCAUCU | 910 | AGAUGAAGUUCAAGAAUAA | 876-894 | 874 |
| 501 | NUAUUCUUGAACUUCAUCU | 911 | AGAUGAAGUUCAAGAAUAN | 876-894 | 874 |
| 502 | NUAUUCUUGAACUUCAUCN | 912 | NGAUGAAGUUCAAGAAUAN | 876-894 | 874 |
| 503 | UUAUGGAGAGCAGUAUCUC | 913 | GAGAUACUGCUCUCCAUAA | 1280-1298 | 1278 |
| 504 | NUAUGGAGAGCAGUAUCUC | 914 | GAGAUACUGCUCUCCAUAN | 1280-1298 | 1278 |
| 505 | NUAUGGAGAGCAGUAUCUN | 915 | NAGAUACUGCUCUCCAUAN | 1280-1298 | 1278 |
| 506 | UAAUGCUGAGAAAUACUCC | 916 | GGAGUAUUUCUCAGCAUUA | 1321-1339 | 1319 |
| 507 | NAAUGCUGAGAAAUACUCC | 917 | GGAGUAUUUCUCAGCAUUN | 1321-1339 | 1319 |
| 508 | NAAUGCUGAGAAAUACUCN | 918 | NGAGUAUUUCUCAGCAUUN | 1321-1339 | 1319 |
| 509 | UGAAUGCUGAGAAAUACUC | 919 | GAGUAUUUCUCAGCAUUCA | 1322-1340 | 1320 |
| 510 | NGAAUGCUGAGAAAUACUC | 920 | GAGUAUUUCUCAGCAUUCN | 1322-1340 | 1320 |
| 511 | NGAAUGCUGAGAAAUACUN | 921 | NAGUAUUUCUCAGCAUUCN | 1322-1340 | 1320 |
| 512 | UCAAUGUCAUCUUCUCUCC | 922 | GGAGAGAAGAUGACAUUGA | 1353-1371 | 1351 |
| 513 | NCAAUGUCAUCUUCUCUCC | 923 | GGAGAGAAGAUGACAUUGN | 1353-1371 | 1351 |
| 514 | NCAAUGUCAUCUUCUCUCN | 924 | NGAGAGAAGAUGACAUUGN | 1353-1371 | 1351 |
| 515 | ACAAAUUCCAGUUAUGUUA | 925 | UAACAUAACUGGAAUUUGU | 2008-2026 | 2006 |
| 516 | UCAAAUUCCAGUUAUGUUA | 926 | UAACAUAACUGGAAUUUGA | 2008-2026 | 2006 |
| 517 | NCAAAUUCCAGUUAUGUUA | 927 | UAACAUAACUGGAAUUUGN | 2008-2026 | 2006 |
| 518 | NCAAAUUCCAGUUAUGUUN | 928 | NAACAUAACUGGAAUUUGN | 2008-2026 | 2006 |
| 519 | UUCAAUUGUGAUAAUGGCU | 929 | AGCCAUUAUCACAAUUGAA | 2158-2176 | 2156 |
| 520 | NUCAAUUGUGAUAAUGGCU | 930 | AGCCAUUAUCACAAUUGAN | 2158-2176 | 2156 |

TABLE 2-continued

XDH RNAi Agent Antisense Strand and Sense Strand Core Stretch Base Sequences

| SEQ ID No. | Antisense Strand Base Sequence (5'→3') (Shown as an Unmodified Nucleotide Sequence) | SEQ ID No. | Sense Strand Base Sequence (5'→3') (Shown as an Unmodified Nucleotide Sequence) | Corresponding Positions of Identified Sequence on SEQ ID NO: 1 | Targeted Gene Position |
|---|---|---|---|---|---|
| 521 | NUCAAUUGUGAUAAUGGCN | 931 | NGCCAUUAUCACAAUUGAN | 2158-2176 | 2156 |
| 522 | AACAUUUUUGCAACAAAGC | 932 | GCUUUGUUGCAAAAAUGUU | 2400-2418 | 2398 |
| 523 | UACAUUUUUGCAACAAAGC | 933 | GCUUUGUUGCAAAAAUGUA | 2400-2418 | 2398 |
| 524 | NACAUUUUUGCAACAAAGC | 934 | GCUUUGUUGCAAAAAUGUN | 2400-2418 | 2398 |
| 525 | NACAUUUUUGCAACAAAGN | 935 | NCUUUGUUGCAAAAAUGUN | 2400-2418 | 2398 |
| 526 | UCAACAUUUUUGCAACAAA | 936 | UUUGUUGCAAAAAUGUUGA | 2402-2420 | 2400 |
| 527 | NCAACAUUUUUGCAACAAA | 937 | UUUGUUGCAAAAAUGUUGN | 2402-2420 | 2400 |
| 528 | NCAACAUUUUUGCAACAAN | 938 | NUUGUUGCAAAAAUGUUGN | 2402-2420 | 2400 |
| 529 | UUUCACUCGAACCACAAUC | 939 | GAUUGUGGUUCGAGUGAAA | 2437-2455 | 2435 |
| 530 | NUUCACUCGAACCACAAUC | 940 | GAUUGUGGUUCGAGUGAAN | 2437-2455 | 2435 |
| 531 | NUUCACUCGAACCACAAUN | 941 | NAUUGUGGUUCGAGUGAAN | 2437-2455 | 2435 |
| 532 | UUGGAAGGCAUUCUCAAUC | 942 | GAUUGAGAAUGCCUUCCAA | 490-508 | 488 |
| 533 | NUGGAAGGCAUUCUCAAUC | 943 | GAUUGAGAAUGCCUUCCAN | 490-508 | 488 |
| 534 | NUGGAAGGCAUUCUCAAUN | 944 | NAUUGAGAAUGCCUUCCAN | 490-508 | 488 |

(N = any nucleobase; I = hypoxanthine (inosine nucleotide); ($A^{2N}$) = 2-aminoadenine nucleotide)

The XDH RNAi agent sense strands and antisense strands that comprise or consist of the sequences in Table 2 can be modified nucleotides or unmodified nucleotides. In some aspects, the XDH RNAi agents having the sense and antisense strand sequences that comprise or consist of the sequences in Table 2 are all or substantially all modified nucleotides.

In some aspects, the antisense strand of an XDH RNAi agent disclosed herein differs by 0, 1, 2, or 3 nucleotides from any of the antisense strand sequences in Table 2. In some aspects, the sense strand of an XDH RNAi agent disclosed herein differs by 0, 1, 2, or 3 nucleotides from any of the sense strand sequences in Table 2.

As used herein, each N listed in a sequence disclosed in Table 2 may be independently selected from any and all nucleo bases (including those found on both modified and unmodified nucleotides). In some aspects, an N nucleotide listed in a sequence disclosed in Table 2 has a nucleobase that is complementary to the N nucleotide at the corresponding position on the other strand. In some aspects, an N nucleotide listed in a sequence disclosed in Table 2 has a nucleobase that is not complementary to the N nucleotide at the corresponding position on the other strand, In some aspects, an N nucleotide listed in a sequence disclosed in Table 2 has a nucleobase that is the same as the N nucleotide at the corresponding position on the other strand. In some aspects, an N nucleotide listed in a sequence disclosed in Table 2 has a nucleobase that is different from the N nucleotide at the corresponding position on the other strand.

Certain modified XDH RNAi agent antisense strands, as well as their underlying unmodified nucleobase sequences, are provided in Table 3. Certain modified XDH RNAi agent sense strands, as well as their underlying unmodified nucleobase sequences, are provided in Table 4. In forming XDH RNAi agents, each of the nucleotides in each of the underlying base sequences listed in Tables 3 and 4, as well as in Table 2, above, can be a modified nucleotide.

The XDH RNAi agents described herein are formed by annealing an antisense strand with a sense strand. A sense strand containing a sequence listed in Table 2 or Table 4, can be hybridized to any antisense strand containing a sequence listed in Table 2 or Table 3, provided the two sequences have a region of at least 85% complementarity over a contiguous 16, 17, 18, 19, 20, or 21 nucleotide sequence.

In some aspects, an XDH RNAi agent antisense strand comprises a nucleotide sequence of any of the sequences in Table 2 or Table 3.

In some aspects, an XDH RNAi agent comprises or consists of a duplex having the nucleobase sequences of the sense strand and the antisense strand of any of the sequences in Table 2, Table 3, or Table 4.

Examples of antisense strands containing modified nucleotides are provided in Table 3 and Table 5C. Examples of sense strands containing modified nucleotides are provided in Table 4 and Table 5C.

As used in Tables 3, 4, and 5C the following notations are used to indicate modified nucleotides and linking groups:

A=adenosine-3'-phosphate;
C=cytidine-3'-phosphate;
G=guanosine-3'-phosphate;
U=uridine-3'-phosphate
I=inosine-3'-phosphate
a=2'-O-methyladenosine-3'-phosphate
as=2'-O-methyladenosine-3'-phosphorothioate
c=2'-O-methylcytidine-3'-phosphate
cs=2'-O-methylcytidine-3'-phosphorothioate
g=2'-O-methylguanosine-3'-phosphate
gs=2'-O-methylguanosine-3'-phosphorothioate t=2'-O-methyl-5-methyluridine-3'-phosphate
is=2'-O-methyl-5-methyluridine-3'-phosphorothioate
u=2'-O-methyluridine-3'-phosphate
us=2'-O-methyluridine-3'-phosphorothioate
i=2'-O-methylinosine-3'-phosphate
is=2'-O-methylinosine-3'-phosphorothioate
Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
$A_{UNA}$=2',3'-seco-adenosine-3'-phosphate, see Table 6
$A_{UNAS}$=2',3'-seco-adenosine-3'-phosphorothioate, see Table 6
$C_{UNA}$=2',3'-seco-cytidine-3'-phosphate, see Table 6
$C_{UNAS}$=2',3'-seco-cytidine-3'-phosphorothioate, see Table 6
$G_{UNA}$=2',3'-seco-guanosine-3'-phosphate, see Table 6
$G_{UNAS}$=2',3'-seco-guanosine-3'-phosphorothioate, see Table 6
$U_{UNA}$=2',3'-seco-uridine-3'-phosphate, see Table 6
$U_{UNAS}$=2',3'-seco-uridine-3'-phosphorothioate, see Table 6
a_2N=2'-O-methyl-2-aminoadenosine-3'-phosphate, see Table 6
a_2Ns=2'-O-methyl-2-aminoadenosine-3'-phosphorothioate, see Table 6
(invAb)=inverted abasic deoxyribonucleotide, see Table 6
(invAb)s=inverted abasic deoxyribonucleotide-5'-phosphorothioate, see Table 6
cPrpa=5'-cyclopropyl phosphonate-2'-O-methyladenosine-3'-phosphate (see Table 6)
cPrpas=5'-cyclopropyl phosphonate-2'-O-methyladenosine-3'-phosphorothioate (see Table 6)
cPrpu=5'-cyclopropyl phosphonate-2'-O-methyluridine-3'-phosphate (see Table 6)
cPrpus=5'-cyclopropyl phosphonate-2'-O-methyluridine-3'-phosphorothioate (see Table 6)

As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the various aspects disclosed herein, when viewing the respective strand 5'→3', the inverted abasic residues are inserted such that the 3' position of the deoxyribose is linked at the 3' end of the preceding monomer on the respective strand (see, e.g., Table 6). Moreover, as the person of ordinary skill would readily understand and appreciate, while the phosphorothioate chemical structures depicted herein typically show the anion on the sulfur atom, the inventions disclosed herein encompass all phosphorothioate tautomers and resonance structures (e.g., where the sulfur atom has a double-bond and the anion is on an oxygen atom). Unless expressly indicated otherwise herein, such understandings of the person of ordinary skill in the art are used when describing the XDH RNAi agents and compositions of XDH RNAi agents disclosed herein.

Certain examples of targeting ligands, targeting groups, and linking groups used with the XDH RNAi agents disclosed herein are provided below in Table 6. More specifically, targeting groups and linking groups (which together can form a targeting ligand) include (NAG37) and (NAG37)s, for which their chemical structures are provided below in Table 6. Each sense strand and/or antisense strand can have any targeting ligands, targeting groups, or linking groups listed herein, as well as other groups, conjugated to the 5' and/or 3' end of the sequence.

TABLE 3

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM13029-AS | usUfsgsGfaAfgGfcAfuUfcUfcAfaUfcUfsc | 945 | UUGGAAGGCAUUCUCAAUCUC | 1352 |
| AM13031-AS | usUfsggaAfgGfCfauucUfcAfaucusc | 946 | UUGGAAGGCAUUCUCAAUCUC | 1352 |
| AM13033-AS | asAfscsUfuGfaAfgAfaGfaAfgCfuGfaGfsg | 947 | AACUUGAAGAAGAAGCUGAGG | 1353 |
| AM13035-AS | asGfsasAfcUfuGfaAfgAfaGfaAfgCfuGfsc | 948 | AGAACUUGAAGAAGAAGCUGC | 1354 |
| AM13037-AS | usGfsusAfgAfaCfuUfgAfaGfaAfgAfaGfsc | 949 | UGUAGAACUUGAAGAAGAAGC | 1355 |
| AM13039-AS | usCfsasUfaGfgUfgAfuUfuUfcAfcCfcCfsu | 950 | UCAUAGGUGAUUUUCACCCCU | 1356 |
| AM13041-AS | usUfsusCfaUfaGfgUfgAfuUfuUfcAfcCfsc | 951 | UUUCAUAGGUGAUUUUCACCC | 1357 |
| AM13043-AS | usCfsusUfcAfuAfgGfuGfaUfuUfuCfaCfsc | 952 | UCUUCAUAGGUGAUUUUCACC | 1358 |
| AM13045-AS | usUfscsUfuCfaUfaGfgUfgAfuUfuUfcAfsc | 953 | UUCUUCAUAGGUGAUUUUCAC | 1359 |
| AM13047-AS | asAfsusUfgUfgAfuAfaUfgGfcUfgGfuAfsg | 954 | AAUUGUGAUAAUGGCUGGUAG | 1360 |

TABLE 3-continued

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM13049-AS | usCfsasUfaAfaAfgGfaGfuUfgUfuCfuUfsc | 955 | UCAUAAAAGGAGUUGUUCUUC | 1361 |
| AM13051-AS | usCfscsAfuAfaAfaGfgAfgUfuGfuUfcUfsc | 956 | UCCAUAAAAGGAGUUGUUCUC | 1362 |
| AM13053-AS | usAfscsAfgUfgUfuAfgUfgCfuUfgUfcUfsc | 957 | UACAGUGUUAGUGCUUGUCUC | 1363 |
| AM13055-AS | usUfsgsUfgUfaCfaUfaCfuCfaUfgAfcGfsa | 958 | UUGUGUACAUACUCAUGACGA | 1364 |
| AM13057-AS | usAfscsCfaGfuUfaUfcAfgCfaUfgUfcCfsu | 959 | UACCAGUUAUCAGCAUGUCCU | 1365 |
| AM13059-AS | usAfsusGfaAfgCfcAfaCfcUfuGfuAfuCfsc | 960 | UAUGAAGCCAACCUUGUAUCC | 1366 |
| AM13061-AS | usCfsusUfcAfuGfaAfgCfcAfaCfcUfuGfsc | 961 | UCUUCAUGAAGCCAACCUUGC | 1367 |
| AM13063-AS | usUfscsUfuCfaUfgAfaGfcCfaAfcCfuUfsg | 962 | UUCUUCAUGAAGCCAACCUUG | 1368 |
| AM13065-AS | usAfsgsUfcUfuCfaUfgAfaGfcCfaAfcCfsu | 963 | UAGUCUUCAUGAAGCCAACCU | 1369 |
| AM13067-AS | usCfsusUfuUfuCfcAfaCfaAfuUfcUfcCfsu | 964 | UCUUUUUCCAACAAUUCUCCU | 1370 |
| AM13069-AS | usUfscsUfaCfuUfcAfgAfgCfaAfgCfcAfsc | 965 | UUCUACUUCAGAGCAAGCCAC | 1371 |
| AM13071-AS | usAfsusUfuCfuAfcUfuCfaGfaGfcAfaGfsc | 966 | UAUUUCUACUUCAGAGCAAGC | 1372 |
| AM13073-AS | usGfsusCfcAfaUfaUfcAfaUfgGfcAfgGfsg | 967 | UGUCCAAUAUCAAUGGCAGGG | 1373 |
| AM13164-AS | usCfsasGfaAfaAfgUfgGfaCfgAfuCfuUfsg | 968 | UCAGAAAAGUGGACGAUCUUG | 1374 |
| AM13166-AS | asCfsasAfcAfuUfaUfcUfgCfuUfcGfgAfsc | 969 | ACAACAUUAUCUGCUUCGGAC | 1375 |
| AM13168-AS | usCfsasUfaAfuAfcUfcUfgAfgAfgAfgAfsc | 970 | UCAUAAUACUCUGAGAGAGAC | 1376 |
| AM13170-AS | usCfsusUfaUfuCfcAfaAfcUfuGfgUfgGfsg | 971 | UCUUAUUCCAAACUUGGUGGG | 1377 |
| AM13172-AS | usAfsgsUfaAfuCfuUfgCfuUfuAfuGfcAfsg | 972 | UAGUAAUCUUGCUUUAUGCAG | 1378 |
| AM13174-AS | asAfsasGfaAfaUfcUfaGfaAfcAfuUfgUfsc | 973 | AAAGAAAUCUAGAACAUUGUC | 1379 |
| AM13176-AS | usCfsasgaaaagugGfaCfgAfuCfuUfsg | 974 | UCAGAAAAGUGGACGAUCUUG | 1374 |
| AM13177-AS | asCfsasacauUfaUfcUfgCfuUfcggasc | 975 | ACAACAUUAUCUGCUUCGGAC | 1375 |
| AM13179-AS | usCfsasUfaAfuacucUfgAfgAfgagasc | 976 | UCAUAAUACUCUGAGAGAGAC | 1376 |
| AM13181-AS | asAfsasGfaAfaUfcUfaGfaAfcAfuUfuUfsc | 977 | AAAGAAAUCUAGAACAUUUUC | 1380 |
| AM13204-AS | usCfsasGfaAfaagugGfaCfgAfuCfuUfsg | 978 | UCAGAAAAGUGGACGAUCUUG | 1374 |
| AM13205-AS | usCfsasUfaAfuacucUfgAfgAfgAfgAfsc | 979 | UCAUAAUACUCUGAGAGAGAC | 1376 |
| AM13206-AS | usCfsusUfaUfuccaaAfcUfuGfgUfggsg | 980 | UCUUAUUCCAAACUUGGUGGG | 1377 |
| AM13207-AS | usAfsgsUfaAfucuugCfuUfuAfuGfcAfsg | 981 | UAGUAAUCUUGCUUUAUGCAG | 1378 |
| AM13600-AS | usAfsasCfuUfcacucAfuCfcAfgCfacsu | 982 | UAACUUCACUCAUCCAGCACU | 1381 |
| AM13602-AS | usCfsasAfcuucacuCfaUfcCfagcasc | 983 | UCAACUUCACUCAUCCAGCAC | 1382 |
| AM13604-AS | usGfscsAfacuucacUfcAfuCfcagcsa | 984 | UGCAACUUCACUCAUCCAGCA | 1383 |
| AM13648-AS | usGfsasucauacuuGfgAfgAfgcausc | 985 | UGAUCAUACUUGGAGAGCAUC | 1384 |
| AM13650-AS | usCfsusguucugcAfgAfcGfaucasc | 986 | UCUUGUUCUGCAGACGAUCAC | 1385 |
| AM13652-AS | usGfsasucuuguucUfgCfaGfacgasc | 987 | UGAUCUUGUUCUGCAGACGAC | 1386 |
| AM13654-AS | usAfsgsuaaaguugCfaCfuGfgcgasc | 988 | UAGUAAAGUUGCACUGGCGAC | 1387 |
| AM13656-AS | usAfsasCfacaaguaAfcCfuUfauccsu | 989 | UAACACAAGUAACCUUAUCCU | 1388 |
| AM13658-AS | usCfsasAfuugugauAfaUfgGfcuggsu | 990 | UCAAUUGUGAUAAUGGCUGGU | 1389 |
| AM13660-AS | usAfsgscaugauacUfgAfgAfgcuusg | 991 | UAGCAUGAUACUGAGAGCUUG | 1390 |

TABLE 3-continued

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM13662-AS | asAfscsUfugucaacCfuCfaCfucuusc | 992 | AACUUGUCAACCUCACUCUUC | 1391 |
| AM13664-AS | usAfsasCfuugucaaCfcUfcAfcucusc | 993 | UAACUUGUCAACCUCACUCUC | 1392 |
| AM13666-AS | usAfsasCfaauucucCfuUfgUfugaasc | 994 | UAACAAUUCUCCUUGUUGAAC | 1393 |
| AM13668-AS | usCfsasuguucuguGfgUfaUfguucsc | 995 | UCAUGUUCUGUGGUAUGUUCC | 1394 |
| AM13670-AS | usAfscsUfuUfaauagAfuCfcAfuguusc | 996 | UACUUUAAUAGAUCCAUGUUC | 1395 |
| AM13672-AS | usGfsascuuuAfaUfaGfaUfcCfaugusc | 997 | UGACUUUAAUAGAUCCAUGUC | 1396 |
| AM13674-AS | usGfscsauauucacCfaUfuUfaggcsa | 998 | UGCAUAUUCACCAUUUAGGCA | 1397 |
| AM13676-AS | usGfsusUfuaagcuuCfuAfgAfgguusc | 999 | UGUUUAAGCUUCUAGAGGUUC | 1398 |
| AM13678-AS | usUfsgsuucauuggUfuUfgAfaggcsc | 1000 | UUGUUCAUUGGUUUGAAGGCC | 1399 |
| AM13680-AS | usUfsasUfgCfuuugcUfgUfuCfauugsg | 1001 | UUAUGCUUUGCUGUUCAUUGG | 1400 |
| AM13682-AS | usGfsusUfaugcuuuGfcUfgUfuCfausc | 1002 | UGUUAUGCUUUGCUGUUCAUC | 1401 |
| AM13684-AS | asGfsgsUfuaugcuuUfgCfuGfuucasc | 1003 | AGGUUAUGCUUUGCUGUUCAC | 1402 |
| AM13686-AS | usAfsasgguuaugcUfuUfgCfuguusc | 1004 | UAAGGUUAUGCUUUGCUGUUC | 1403 |
| AM13688-AS | asGfsasUfucaagguUfaUfgCfuuugsc | 1005 | AGAUUCAAGGUUAUGCUUUGC | 1404 |
| AM13690-AS | usUfscsAfauaauugAfgUfuGfguugsg | 1006 | UUCAAUAAUUGAGUUGGUUGG | 1405 |
| AM13692-AS | asGfsusAfaaauggaUfcAfcAfggaasg | 1007 | AGUAAAAUGGAUCACAGGAAG | 1406 |
| AM13694-AS | usCfsasUfaugacagUfaAfgAfaaacsc | 1008 | UCAUAUGACAGUAAGAAAACC | 1407 |
| AM13696-AS | usUfsgsgaaggcauUfcUfcGfaucusc | 1009 | UUGGAAGGCAUUCUCGAUCUC | 1408 |
| AM13698-AS | usCfsasUfcauugaaAfaUfgCfcagusc | 1010 | UCAUCAUUGAAAAUGCCAGUC | 1409 |
| AM13700-AS | asAfsasGfacaguuuCfaUfcAfuugasc | 1011 | AAAGACAGUUUCAUCAUUGAC | 1410 |
| AM13702-AS | asAfscsacaaguaaCfcUfcAfuccusc | 1012 | AACACAAGUAACCUCAUCCUC | 1411 |
| AM13704-AS | asGfsascaacauugUfcAfgCfuucasg | 1013 | AGACAACAUUGUCAGCUUCAG | 1412 |
| AM13706-AS | usCfsasacaucuuuGfcAfaUfaaagsc | 1014 | UCAACAUCUUUGCAAUAAAGC | 1413 |
| AM13708-AS | asGfsasUfuagucuuAfcAfaAfuccusc | 1015 | AGAUUAGUCUUACAAAUCCUC | 1414 |
| AM13710-AS | usCfsusUfauuccaaAfcUfuAfgucgsg | 1016 | UCUUAUUCCAAACUUAGUCGG | 1415 |
| AM13712-AS | usCfsasGfaaaagaaAfgUfgUfgaagsc | 1017 | UCAGAAAAGAAAGUGUGAAGC | 1416 |
| AM13714-AS | usAfsgsAfguuugucUfcAfaAfgcugsc | 1018 | UAGAGUUUGUCUCAAAGCUGC | 1417 |
| AM13716-AS | usUfsgsUfuaagcagUfcAfaUfuUfcusc | 1019 | UUGUUAAGCAGUCAAUUUCUC | 1418 |
| AM13718-AS | usUfsgsGfaaaucugGfaUfaCfuacgsg | 1020 | UUGGAAAUCUGGAUACUACGG | 1419 |
| AM13720-AS | usCfsusUfgaaaaugCfcAfuCfcugcsu | 1021 | UCUUGAAAAUGCCAUCCUGCU | 1420 |
| AM13722-AS | asUfsgsAfuuuggauCfaCfaAfuugusc | 1022 | AUGAUUUGGAUCACAAUUGUC | 1421 |
| AM13724-AS | usAfsgsAfauuacucAfaAfaCfugccsa | 1023 | UAGAAUUACUCAAAACUGCCA | 1422 |
| AM13726-AS | usGfsasucaaAfAfauGfgAfcUfcagasc | 1024 | UGAUCAAAAAUGGACUCAGAC | 1423 |
| AM13728-AS | usAfsasGfaaagcauGfcAfgAfucuasg | 1025 | UAAGAAAGCAUGCAGAUCUAG | 1424 |
| AM13730-AS | usCfsasgauauaagCfuCfuCfugaasg | 1026 | UCAGAUAUAAGCUCUCUGAAG | 1425 |
| AM13747-AS | usAfsusGfaagccaaCfcUfuGfuAfucsc | 1027 | UAUGAAGCCAACCUUGUAUCC | 1366 |

TABLE 3-continued

| XDH RNAi Agent Antisense Strand Sequences | | | | |
|---|---|---|---|---|
| Antisense Strand ID: | Modified Antisense Strand (5'→3') | SEQ ID NO. | Underlying Base Sequence (5'→3') (Shown as an Unmodified Nucleotide Sequence) | SEQ ID NO. |
| AM13748-AS | usAfsusGfaagccaaCfcUfuGfuaucsc | 1028 | UAUGAAGCCAACCUUGUAUCC | 1366 |
| AM13749-AS | usAfsusGfaagC$_{UNA}$caaCfcUfuGfuaucsc | 1029 | UAUGAAGCCAACCUUGUAUCC | 1366 |
| AM13753-AS | usAfsusGfaagucaaCfcUfuGfuaucsc | 1030 | UAUGAAGUCAACCUUGUAUCC | 1426 |
| AM13754-AS | usAfsusGfaagcuaaCfcUfuGfuaucsc | 1031 | UAUGAAGCCAACCUUGUAUCC | 1427 |
| AM13755-AS | cPrpusAfsusGfaagccaaCfcUfuGfuaucsc | 1032 | UAUGAAGCCAACCUUGUAUCC | 1366 |
| AM13758-AS | usCfsusUfcaugaagCfcAfaCfcuugsc | 1033 | UCUUCAUGAAGCCAACCUUGC | 1367 |
| AM13759-AS | cPrpusCfsusUfcaugaagCfcAfaCfcuugsc | 1034 | UCUUCAUGAAGCCAACCUUGC | 1367 |
| AM13761-AS | usCfsusUfcaU$_{UNA}$gaagCfcAfaCfcuugsc | 1035 | UCUUCAUGAAGCCAACCUUGC | 1367 |
| AM13858-AS | usGfsgsAfuCfugcauUfuUfuCfuCfcasc | 1036 | UGGAUCUGCAUUUUUCUCCAC | 1428 |
| AM13860-AS | usCfscsAfaAfaggguUfgUfcUfcUfggsa | 1037 | UCCAAAAGGGUUGUCUCUGGA | 1429 |
| AM13862-AS | usAfsgsAfcGfaucauAfcUfuGfgAfgasg | 1038 | UAGACGAUCAUACUUGGAGAG | 1430 |
| AM13864-AS | usCfscsUfaUfuccuuCfcAfcAfgUfugsc | 1039 | UCCUAUUCCUUCCACAGUUGC | 1431 |
| AM13866-AS | usAfscsAfuAfcucauGfaCfgAfuGfccsa | 1040 | UACAUACUCAUGACGAUGCCA | 1432 |
| AM13868-AS | usCfsasCfaGfauuucCfuUfgGfaAfggsc | 1041 | UCACAGAUUUCCUUGGAAGGC | 1433 |
| AM13870-AS | usGfsasAfcUfucaucUfcAfaUfgCfcasc | 1042 | UGAACUUCAUCUCAAUGCCAC | 1434 |
| AM13872-AS | asGfscsAfuAfuucuuGfaAfcUfuCfausc | 1043 | AGCAUAUUCUUGAACUUCAUC | 1435 |
| AM13874-AS | usCfsasUfaGfgaaacAfgCfaUfaUfucsc | 1044 | UCAUAGGAAACAGCAUAUUCC | 1436 |
| AM13876-AS | usGfsgsAfuCfucuauGfgAfgAfgCfagsc | 1045 | UGGAUCUCUAUGGAGAGCAGC | 1437 |
| AM13878-AS | usUfsusGfaAfugcugAfgAfaAfuAfcusc | 1046 | UUUGAAUGCUGAGAAAUACUC | 1438 |
| AM13880-AS | usCfsusAfuGfgacuuGfaUfcUfuGfgcsg | 1047 | UCUAUGGACUUGAUCUUGGCG | 1439 |
| AM13882-AS | asUfsgsAfaAfcaaacAfaAfcCfcUfggsa | 1048 | AUGAAACAAACAAACCCUGGA | 1440 |
| AM13884-AS | usGfsgsUfaGfuucuuCfaUfaGfgUfgasc | 1049 | UGGUAGUUCUUCAUAGGUGAC | 1441 |
| AM13886-AS | usGfsasUfaAfuggcuGfgUfaGfuUfcusc | 1050 | UGAUAAUGGCUGGUAGUUCUC | 1442 |
| AM13888-AS | usCfsusCfaAfuugugAfuAfaUfgGfcusg | 1051 | UCUCAAUUGUGAUAAUGGCUG | 1443 |
| AM13890-AS | usCfsusUfuCfucgauCfuUfcAfgCfucsa | 1052 | UCUUUCUCGAUCUUCAGCUCA | 1444 |
| AM13892-AS | usUfsusGfgAfacagcAfaUfgGfuGfcasg | 1053 | UUUGGAACAGCAAUGGUGCAG | 1445 |
| AM13894-AS | usGfsusAfgAfcacaaAfgAfgCfuCfcasc | 1054 | UGUAGACACAAAGAGCUCCAC | 1446 |
| AM13896-AS | usCfsusGfuGfuagacAfcAfaAfgAfgcsu | 1055 | UCUGUGUAGACACAAAGAGCU | 1447 |
| AM13898-AS | usUfscsCfaUfaauacUfcUfgAfgAfgasg | 1056 | UUCCAUAAUACUCUGAGAGAG | 1448 |
| AM13900-AS | usCfsusCfgUfuccauAfaUfaCfuCfugsc | 1057 | UCUCGUUCCAUAAUACUCUGC | 1449 |
| AM14175-AS | cPrpusUfsgsAfaAfcaaacAfaAfcCfcUfggsa | 1058 | UUGAAACAAACAAACCCUGGA | 1450 |
| AM14176-AS | cPrpusUfscsCfaUfaauacUfcUfgAfgAfgasg | 1059 | UUCCAUAAUACUCUGAGAGAG | 1448 |
| AM14204-AS | asAfsusGfaaacaaaCfaAfaCfccugsg | 1060 | AAUGAAACAAACAAACCCUGG | 1451 |
| AM14206-AS | asAfsasUfgaaacaaAfcAfaAfcccusg | 1061 | AAAUGAAACAAACAAACCCUG | 1452 |
| AM14208-AS | usGfsasAfaugaaacAfaAfcAfaaccsc | 1062 | UGAAAUGAAACAAACAAACCC | 1453 |
| AM14209-AS | usUfsgsAfaAfcaaacAfaAfcCfcUfggsa | 1063 | UUGAAACAAACAAACCCUGGA | 1450 |
| AM14210-AS | cPrpusUfsgsAfaacaaacAfaAfcCfcuggsa | 1064 | UUGAAACAAACAAACCCUGGA | 1450 |

TABLE 3-continued

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM14211-AS | cPrpuUfgAfaacaaacAfaAfcCfcuggsa | 1065 | UUGAAACAAACAAACCCUGGA | 1450 |
| AM14212-AS | cPrpuUfgAfaacaaacAfaAfcCfcugsgsa | 1066 | UUGAAACAAACAAACCCUGGA | 1450 |
| AM14216-AS | asGfsasCfgaucauaCfuUfgGfagagsc | 1067 | AGACGAUCAUACUUGGAGAGC | 1454 |
| AM14218-AS | asAfsgsGfcauucucAfaUfcUfccucsc | 1068 | AAGGCAUUCUCAAUCUCCUCC | 1455 |
| AM14220-AS | usUfsusCfcuuggaaGfgCfaUfucucsg | 1069 | UUUCCUUGGAAGGCAUUCUCG | 1456 |
| AM14222-AS | usAfsgsAfuuuccuuGfgAfaGfgcausc | 1070 | UAGAUUUCCUUGGAAGGCAUC | 1457 |
| AM14224-AS | asUfsasGfgaaacagCfaUfaUfucuusg | 1071 | AUAGGAAACAGCAUAUUCUUG | 1458 |
| AM14226-AS | usUfsgsAfugauguuCfcCfuCfcaacsg | 1072 | UUGAUGAUGUUCCCUCCAACG | 1459 |
| AM14228-AS | usAfsgsAfacuugaaGfaAfgAfagcusg | 1073 | UAGAACUUGAAGAAGAAGCUG | 1460 |
| AM14230-AS | usAfscsCfaaugauaUfgCfcCfaacasc | 1074 | UACCAAUGAUAUGCCCAACAC | 1461 |
| AM14232-AS | usCfsasUfggU$_{UNA}$guucUfgUfgUfagacsg | 1075 | UCAUGGUGUUCUGUGUAGACG | 1462 |
| AM14234-AS | usUfsgsAfgagagauCfcUfgGfgugusc | 1076 | UUGAGAGAGAUCCUGGGUGUC | 1463 |
| AM14236-AS | usCfsasUfgauacugAfgAfgCfuugcsu | 1077 | UCAUGAUACUGAGAGCUUGCU | 1464 |
| AM14238-AS | usUfsgsUfcaaccucAfcUfcUfuccgsa | 1078 | UUGUCAACCUCACUCUUCCGA | 1465 |
| AM14240-AS | usUfsusCfcaacaauUfcUfcCfuugusc | 1079 | UUUCCAACAAUUCUCCUUGUC | 1466 |
| AM14242-AS | usUfsgsAfguuagucUfcAfaAfgcugsc | 1080 | UUGAGUUAGUCUCAAAGCUGC | 1467 |
| AM14244-AS | asUfsgsAfcaauaucUfgUfgCfggagsg | 1081 | AUGACAAUAUCUGUGCGGAGG | 1468 |
| AM14246-AS | usCfsasUfgacaauaUfcUfgUfgcggsa | 1082 | UCAUGACAAUAUCUGUGCGGA | 1469 |
| AM14248-AS | usCfsasAfagaagauAfgAfaGfcagcsc | 1083 | UCAAAGAAGAUAGAAGCAGCC | 1470 |
| AM14250-AS | usCfsasCfguuauuaCfcUfgUfgugcsu | 1084 | UCACGUUAUUACCUGUGUGCU | 1471 |
| AM14252-AS | usAfsgsAfacuugagGfuUfaUfacagsg | 1085 | UAGAACUUGAGGUUAUACAGG | 1472 |
| AM14254-AS | asUfsgsCfuuugcugUfuCfaUfuggusc | 1086 | AUGCUUUGCUGUUCAUUGGUC | 1473 |
| AM14256-AS | usAfsgsUfauagauuCfaAfgGfuuausg | 1087 | UAGUAUAGAUUCAAGGUUAUG | 1474 |
| AM14258-AS | asGfsasGfuaaucuuGfcUfuUfaugcsc | 1088 | AGAGUAAUCUUGCUUUAUGCC | 1475 |
| AM14260-AS | asUfsasGfcaucauuUfcUfaGfguggsa | 1089 | AUAGCAUCAUUUCUAGGUGGA | 1476 |
| AM14262-AS | asGfsasCfagaagagAfcAfgAfgcuasg | 1090 | AGACAGAAGAGACAGAGCUAG | 1477 |
| AM14264-AS | asGfsusAfagaaaacCfaAfgCfcuuasg | 1091 | AGUAAGAAAACCAAGCCUUAG | 1478 |
| AM14280-AS | usUfscsCfauaauacUfcUfgAfgagasg | 1092 | UUCCAUAAUACUCUGAGAGAG | 1448 |
| AM14281-AS | cPrpusUfscsCfauaauacUfcUfgAfgagasg | 1093 | UUCCAUAAUACUCUGAGAGAG | 1448 |
| AM14282-AS | cPrpuUfcCfauaauacUfcUfgAfgagasg | 1094 | UUCCAUAAUACUCUGAGAGAG | 1448 |
| AM14283-AS | cPrpuUfcCfauaauacUfcUfgAfgagsasg | 1095 | UUCCAUAAUACUCUGAGAGAG | 1448 |
| AM14285-AS | cPrpuUfccauaaUfacUfcUfgAfgagasg | 1096 | UUCCAUAAUACUCUGAGAGAG | 1448 |
| AM14288-AS | usAfsusAfcuuggagAfgCfaUfcacusg | 1097 | UAUACUUGGAGAGCAUCACUG | 1479 |
| AM14290-AS | usUfsgsCfagacgauCfaUfaCfuuggsc | 1098 | UUGCAGACGAUCAUACUUGGC | 1480 |
| AM14292-AS | usUfsgsAfaUfaaaacUfcUfcAfugccsa | 1099 | UUGAAUAAAACUCUCAUGCCA | 1481 |
| AM14293-AS | cPrpusUfsgsAfaUfaaaacUfcUfcAfugccsa | 1100 | UUGAAUAAAACUCUCAUGCCA | 1482 |

TABLE 3-continued

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM14296-AS | usAfscsUfuGfaAfgAfaGfaAfgCfuGfaGfsg | 1101 | UACUUGAAGAAGAAGCUGAGG | 1482 |
| AM14297-AS | usAfscsUfugaagaaGfaAfgCfugagsg | 1102 | UACUUGAAGAAGAAGCUGAGG | 1482 |
| AM14298-AS | cPrpusAfscsUfugaagaaGfaAfgCfugagsg | 1103 | UACUUGAAGAAGAAGCUGAGG | 1482 |
| AM14299-AS | cPrpuAfcUfugaagaaGfaAfgCfugagsg | 1104 | UACUUGAAGAAGAAGCUGAGG | 1482 |
| AM14301-AS | cPrpuAfcUfugaagaaGfaAfgCfugasgsg | 1105 | UACUUGAAGAAGAAGCUGAGG | 1482 |
| AM14304-AS | cPrpuAfcuugAfagaaGfaAfgCfugagsg | 1106 | UACUUGAAGAAGAAGCUGAGG | 1482 |
| AM14305-AS | cPrpuAfcuugaaGfaaGfaAfgCfugagsg | 1107 | UACUUGAAGAAGAAGCUGAGG | 1482 |
| AM14383-AS | cPrpusUfsusGfaAfugcugAfgAfaAfuAfcusc | 1108 | UUUGAAUGCUGAGAAAUACUC | 1438 |
| AM14384-AS | cPrpusUfsusGfaaugcugAfgAfaAfuacusc | 1109 | UUUGAAUGCUGAGAAAUACUC | 1438 |
| AM14385-AS | cPrpusUfsusgaaUfgcugAfgAfaAfuacusc | 1110 | UUUGAAUGCUGAGAAAUACUC | 1438 |
| AM14387-AS | cPrpuUfuGfaaugcugAfgAfaAfuacusc | 1111 | UUUGAAUGCUGAGAAAUACUC | 1438 |
| AM14388-AS | cPrpuUfuGfaaugcugAfgAfaAfuacsusc | 1112 | UUUGAAUGCUGAGAAAUACUC | 1438 |
| AM14391-AS | asGfsasAfaAfguggaCfgAfuCfuUfgusc | 1113 | AGAAAAGUGGACGAUCUUGUC | 1483 |
| AM14393-AS | usAfsgsUfuGfucacuGfcAfaCfaUfggsu | 1114 | UAGUUGUCACUGCAACAUGGU | 1484 |
| AM14395-AS | asUfsusCfcUfuccacAfgUfuGfuCfacsc | 1115 | AUUCCUUCCACAGUUGUCACC | 1485 |
| AM14397-AS | usGfscsAfuUfcucaaUfcUfcCfuCfcasc | 1116 | UGCAUUCUCAAUCUCCUCCAC | 1486 |
| AM14399-AS | usUfscsAfaUfgccaaUfcUfcCfgUfgusc | 1117 | UUCAAUGCCAAUCUCCGUGUC | 1487 |
| AM14401-AS | asUfsasUfuCfuugaaCfuUfcAfuCfucsg | 1118 | AUAUUCUUGAACUUCAUCUCG | 1488 |
| AM14403-AS | usUfsasUfgGfagagcAfgUfaUfcUfccsu | 1119 | UUAUGGAGAGCAGUAUCUCCU | 1489 |
| AM14405-AS | usAfsasUfgCfugagaAfaUfaCfuCfccsc | 1120 | UAAUGCUGAGAAAUACUCCCC | 1490 |
| AM14407-AS | usGfsasAfuGfcugagAfaAfuAfcUfccsc | 1121 | UGAAUGCUGAGAAAUACUCCC | 1491 |
| AM14409-AS | usCfsasAfuGfucaucUfuCfuCfuCfcgsg | 1122 | UCAAUGUCAUCUUCUCUCCGG | 1492 |
| AM14411-AS | asCfsasAfaUfuccagUfuAfuGfuUfacsc | 1123 | ACAAAUUCCAGUUAUGUUACC | 1493 |
| AM14413-AS | usUfscsAfaUfugugaUfaAfuGfgCfugsg | 1124 | UUCAAUUGUGAUAAUGGCUGG | 1494 |
| AM14415-AS | asAfscsAfuUfuuugcAfaCfaAfaGfcusc | 1125 | AACAUUUUUGCAACAAAGCUC | 1495 |
| AM14417-AS | usCfsasAfcAfuuuuuGfcAfaCfaAfagsc | 1126 | UCAACAUUUUUGCAACAAAGC | 1496 |
| AM14419-AS | usUfsusCfaCfucgaaCfcAfcAfaUfccsg | 1127 | UUUCACUCGAACCACAAUCCG | 1497 |
| AM14522-AS | cPrpusCfsusUfaUfuccaaAfcUfuGfgUfggsg | 1128 | UCUUAUUCCAAACUUGGUGGG | 1377 |
| AM14523-AS | cPrpuCfuUfaUfuccaaAfcUfuGfgUfggsg | 1129 | UCUUAUUCCAAACUUGGUGGG | 1377 |
| AM14524-AS | cPrpuCfuuauucCfaaAfcUfuGfguggsg | 1130 | UCUUAUUCCAAACUUGGUGGG | 1377 |
| AM14527-AS | cPrpuGfcauauucacCfaUfuUfaggcsa | 1131 | UGCAUAUUCACCAUUUAGGCA | 1397 |
| AM14529-AS | cPrpuGfcauaUfucacCfaUfuUfaggcsa | 1132 | UGCAUAUUCACCAUUUAGGCA | 1397 |
| AM14530-AS | cPrpuGfcauauuCfacCfaUfuUfaggcsa | 1133 | UGCAUAUUCACCAUUUAGGCA | 1397 |
| AM14543-AS | usGfscauauucacCfaUfuUfaggcsa | 1134 | UGCAUAUUCACCAUUUAGGCA | 1397 |
| AM14544-AS | usGfscauaUfucacCfaUfuUfaggcsa | 1135 | UGCAUAUUCACCAUUUAGGCA | 1397 |
| AM14545-AS | usGfscauauuCfacCfaUfuUfaggcsa | 1136 | UGCAUAUUCACCAUUUAGGCA | 1397 |
| AM14642-AS | cPrpasUfsgsAfaacaaacAfaAfcCfcuggsa | 1137 | AUGAAACAAACAAACCCUGGA | 1440 |

TABLE 3-continued

XDH RNAi Agent Antisense Strand Sequences

| Antisense Strand ID: | Modified Antisense Strand (5'→3') | SEQ ID NO. | Underlying Base Sequence (5'→3') (Shown as an Unmodified Nucleotide Sequence) | SEQ ID NO. |
|---|---|---|---|---|
| AM14643-AS | cPrpasUfsgsAfaacaaacAfaAfcCfcugsgsa | 1138 | AUGAAACAAACAAACCCUGGA | 1440 |
| AM14644-AS | cPrpasUfsgAfaacaaacAfaAfcCfcugsgsa | 1139 | AUGAAACAAACAAACCCUGGA | 1440 |
| AM14645-AS | cPrpaUfgAfaacaaacAfaAfcCfcugsgsa | 1140 | AUGAAACAAACAAACCCUGGA | 1440 |
| AM14647-AS | cPrpasUfsgaaacaAfacAfaAfcCfcugsgsa | 1141 | AUGAAACAAACAAACCCUGGA | 1440 |
| AM14648-AS | cPrpasUfsgaaaCfaaacAfaAfcCfcugsgsa | 1142 | AUGAAACAAACAAACCCUGGA | 1440 |
| AM14649-AS | cPrpasUfsgaAfacaaacAfaAfcCfcugsgsa | 1143 | AUGAAACAAACAAACCCUGGA | 1440 |
| AM14650-AS | cPrpasUfsgAfaaCfaAfacAfaAfcCfcugsgsa | 1144 | AUGAAACAAACAAACCCUGGA | 1440 |
| AM15134-AS | cPrpusUfscCfauaauacUfcUfgAfgagasg | 1145 | UUCCAUAAUACUCUGAGAGAG | 1448 |
| AM15135-AS | cPrpusUfscCfauaauacUfcUfgAfgagsasg | 1146 | UUCCAUAAUACUCUGAGAGAG | 1448 |
| AM15137-AS | cPrpuUfcCfauaauacUfcUfgAfgagasc | 1147 | UUCCAUAAUACUCUGAGAGAG | 1498 |
| AM15139-AS | cPrpuUfcCfauaauacUfcUfgAfgaggsg | 1148 | UUCCAUAAUACUCUGAGAGGG | 1499 |
| AM15141-AS | cPrpuUfcCfauaauacUfcUfgAfgaggsc | 1149 | UUCCAUAAUACUCUGAGAGGC | 1500 |
| AM15143-AS | cPrpuUfcCfauaauacUfcUfgAfgaggsu | 1150 | UUCCAUAAUACUCUGAGAGGU | 1501 |
| AM15145-AS | cPrpuUfcCfauaauacUfcUfgAfgaggsa | 1151 | UUCCAUAAUACUCUGAGAGGA | 1502 |
| AM15146-AS | cPrpuUfccauAfauacUfcUfgAfgagasg | 1152 | UUCCAUAAUACUCUGAGAGAG | 1448 |
| AM15147-AS | cPrpusGfscsauauuCfacCfaUfuUfaggcsa | 1153 | UGCAUAUUCACCAUUUAGGCA | 1397 |
| AM15148-AS | cPrpusGfscauauuCfacCfaUfuUfaggcsa | 1154 | UGCAUAUUCACCAUUUAGGCA | 1397 |
| AM15149-AS | cPrpusGfscauauuCfacCfaUfuUfaggscsa | 1155 | UGCAUAUUCACCAUUUAGGCA | 1397 |
| AM15150-AS | cPrpuGfcauauuCfacCfaUfuUfaggscsa | 1156 | UGCAUAUUCACCAUUUAGGCA | 1397 |
| AM15151-AS | cPrpusGfscsauaUfucacCfaUfuUfaggcsa | 1157 | UGCAUAUUCACCAUUUAGGCA | 1397 |
| AM15152-AS | cPrpusGfscauaUfucacCfaUfuUfaggcsa | 1158 | UGCAUAUUCACCAUUUAGGCA | 1397 |
| AM15153-AS | cPrpusGfscauaUfucacCfaUfuUfaggscsa | 1159 | UGCAUAUUCACCAUUUAGGCA | 1397 |
| AM15154-AS | cPrpuGfcauaUfucacCfaUfuUfaggscsa | 1160 | UGCAUAUUCACCAUUUAGGCA | 1397 |
| AM15285-AS | asUfsgsacaAfuaucUfgUfgCfggagsg | 1161 | AUGACAAUAUCUGUGCGGAGG | 1468 |
| AM15286-AS | asUfsgsacaauAfucUfgUfgCfggagsg | 1162 | AUGACAAUAUCUGUGCGGAGG | 1468 |
| AM15287-AS | cPrpasUfsgsacaauAfucUfgUfgCfggagsg | 1163 | AUGACAAUAUCUGUGCGGAGG | 1468 |
| AM15289-AS | cPrpusUfsgsacaauAfucUfgUfgCfggagsg | 1164 | UUGACAAUAUCUGUGCGGAGG | 1503 |
| AM15290-AS | cPrpaUfgacaauAfucUfgUfgCfggagsg | 1165 | AUGACAAUAUCUGUGCGGAGG | 1468 |
| AM15291-AS | cPrpaUfgacaauAfucUfgUfgCfggasgsg | 1166 | AUGACAAUAUCUGUGCGGAGG | 1468 |
| AM15292-AS | cPrpasUfsgacaauAfucUfgUfgCfggasgsg | 1167 | AUGACAAUAUCUGUGCGGAGG | 1468 |
| AM15294-AS | cPrpasUfsgsacaauAfucUfgUfgCfggasg | 1168 | AUGACAAUAUCUGUGCGGAG | 1504 |
| AM15296-AS | cPrpasUfsgsacaauAfucUfgUfgCfggsa | 1169 | AUGACAAUAUCUGUGCGGA | 1505 |
| AM15606-AS | cPrpusUfsccauaaUfacUfcUfgAfgagsasg | 1170 | UUCCAUAAUACUCUGAGAGAG | 1448 |
| AM15607-AS | cPrpusUfscCfauaauacUfcUfgAfgagsasc | 1171 | UUCCAUAAUACUCUGAGAGAC | 1498 |
| AM15608-AS | cPrpusUfsgaaaCfaaacAfaAfcCfcugsgsa | 1172 | UUGAAACAAACAAACCCUGGA | 1450 |
| AM15626-AS | asUfsgAfaAfcaaacAfaAfcCfcUfgsgsa | 1173 | AUGAAACAAACAAACCCUGGA | 1440 |

TABLE 3-continued

| XDH RNAi Agent Antisense Strand Sequences | | | | |
|---|---|---|---|---|
| Antisense Strand ID: | Modified Antisense Strand (5'→3') | SEQ ID NO. | Underlying Base Sequence (5'→3') (Shown as an Unmodified Nucleotide Sequence) | SEQ ID NO. |
| AM15627-AS | asUfsgAfaacaaacAfaAfcCfcugsgsa | 1174 | AUGAAACAAACAAACCCUGGA | 1440 |
| AM17243-AS | asCfsucgUfuccauaaUfaCfucugasgsa | 1672 | ACUCGUUCCAUAAUACUCUGAGA | 1674 |
| AM17245-AS | asUfsccaUfaauacucUfgAfgagagsasu | 1673 | AUCCAUAAUACUCUGAGAGAGAU | 1675 |

TABLE 4

| XDH RNAi Agent Sense Strand Sequences | | | | |
|---|---|---|---|---|
| Sense Strand ID: | Modified Sense Strand (5'→3') | SEQ ID NO. | Underlying Base Sequence (5'→3') (Shown as an Unmodified Nucleotide Sequence) | SEQ ID NO. |
| AM13028-SS | (NAG37)s(invAb)sgagauugaGfAfAfugccuuccaas(invAb) | 1175 | GAGAUUGAGAAUGCCUUCCAA | 1506 |
| AM13030-SS | (NAG37)s(invAb)sgagauuGfaGfAfAfugccuuccaas(invAb) | 1176 | GAGAUUGAGAAUGCCUUCCAA | 1506 |
| AM13032-SS | (NAG37)s(invAb)sccucagcuUfCfUfucuucaaguus(invAb) | 1177 | CCUCAGCUUCUUCUUCAAGUU | 1507 |
| AM13034-SS | (NAG37)s(invAb)sgcagcuucUfUfCfuucaaguucus(invAb) | 1178 | GCAGCUUCUUCUUCAAGUUCU | 1508 |
| AM13036-SS | (NAG37)s(invAb)sgcuucuucUfUfCfaaguucuacas(invAb) | 1179 | GCUUCUUCUUCAAGUUCUACA | 1509 |
| AM13038-SS | (NAG37)s(invAb)sagggugaAfAfAfucaccuaugas(invAb) | 1180 | AGGGGUGAAAAUCACCUAUGA | 1510 |
| AM13040-SS | (NAG37)s(invAb)sgggugaaaAfUfCfaccuaugaaas(invAb) | 1181 | GGGUGAAAAUCACCUAUGAAA | 1511 |
| AM13042-SS | (NAG37)s(invAb)sggugaaaaUfCfAfccuaugaagas(invAb) | 1182 | GGUGAAAAUCACCUAUGAAGA | 1512 |
| AM13044-SS | (NAG37)s(invAb)sgugaaaauCfAfCfcuaugaagaas(invAb) | 1183 | GUGAAAAUCACCUAUGAAGAA | 1513 |
| AM13046-SS | (NAG37)s(invAb)scuaccagcCfAfUfuaucacaauus(invAb) | 1184 | CUACCAGCCAUUAUCACAAUU | 1514 |
| AM13048-SS | (NAG37)s(invAb)sgaagaacaAfCfUfccuuuuaugas(invAb) | 1185 | GAAGAACAACUCCUUUUAUGA | 1515 |
| AM13050-SS | (NAG37)s(invAb)sgagaacaaCfUfCfcuuuuauggas(invAb) | 1186 | GAGAACAACUCCUUUUAUGGA | 1516 |
| AM13052-SS | (NAG37)s(invAb)sgagacaagCfAfCfuaacacuguas(invAb) | 1187 | GAGACAAGCACUAACACUGUA | 1517 |
| AM13054-SS | (NAG37)s(invAb)sucgucaugAfGfUfauguacacaas(invAb) | 1188 | UCGUCAUGAGUAUGUACACAA | 1518 |
| AM13056-SS | (NAG37)s(invAb)saggacaugCfUfGfauaacugiuas(invAb) | 1189 | AGGACAUGCUGAUAACUGIUA | 1519 |
| AM13058-SS | (NAG37)s(invAb)sggauacaaGfGfUfuggcuucauas(invAb) | 1190 | GGAUACAAGGUUGGCUUCAUA | 1520 |
| AM13060-SS | (NAG37)s(invAb)sgcaagguuGfGfCfuucaugaagas(invAb) | 1191 | GCAAGGUUGGCUUCAUGAAGA | 1521 |
| AM13062-SS | (NAG37)s(invAb)scaagguugGfCfUfucaugaagaas(invAb) | 1192 | CAAGGUUGGCUUCAUGAAGAA | 1522 |
| AM13064-SS | (NAG37)s(invAb)sagguuggcUfUfCfaugaagacuas(invAb) | 1193 | AGGUUGGCUUCAUGAAGACUA | 1523 |
| AM13066-SS | (NAG37)s(invAb)saggagaauUfGfUfuggaaaaagas(invAb) | 1194 | AGGAGAAUUGUUGGAAAAAGA | 1524 |
| AM13068-SS | (NAG37)s(invAb)sguggcuugCfUfCfugaaguagaas(invAb) | 1195 | GUGGCUUGCUCUGAAGUAGAA | 1525 |
| AM13070-SS | (NAG37)s(invAb)sgcuugcucUfGfAfaguagaaauas(invAb) | 1196 | GCUUGCUCUGAAGUAGAAAUA | 1526 |
| AM13072-SS | (NAG37)s(invAb)scccugccaUfUfGfauauuigacas(invAb) | 1197 | CCCUGCCAUUGAUAUUIGACA | 1527 |
| AM13163-SS | (NAG37)s(invAb)scaagaucgUfCfCfacuuuucugas(invAb) | 1198 | CAAGAUCGUCCACUUUUCUGA | 1528 |
| AM13165-SS | (NAG37)s(invAb)sguccgaagCfAfGfauaauguugus(invAb) | 1199 | GUCCGAAGCAGAUAAUGUUGU | 1529 |
| AM13167-SS | (NAG37)s(invAb)sgucucucuCfAfGfaguauuaugas(invAb) | 1200 | GUCUCUCUCAGAGUAUUAUGA | 1530 |
| AM13169-SS | (NAG37)s(invAb)scccaccaaGfUfUfuggaauaagas(invAb) | 1201 | CCCACCAAGUUUGGAAUAAGA | 1531 |
| AM13171-SS | (NAG37)s(invAb)scugcauaaAfGfCfaagauuacuas(invAb) | 1202 | CUGCAUAAAGCAAGAUUACUA | 1532 |

TABLE 4-continued

XDH RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM13173-SS | (NAG37)s(invAb)sgacaauguUfCfUfagauuucuuus(invAb) | 1203 | GACAAUGUUCUAGAUUUCUUU | 1533 |
| AM13175-SS | (NAG37)s(invAb)scaagaucgUfcCfaCfuuuucugas(invAb) | 1204 | CAAGAUCGUCCACUUUUCUGA | 1528 |
| AM13178-SS | (NAG37)s(invAb)sgucucucuCfaGfaGfuauuaugas(invAb) | 1205 | GUCUCUCUCAGAGUAUUAUGA | 1530 |
| AM13180-SS | (NAG37)s(invAb)sgaaaauguUfCfUfagauuucuuus(invAb) | 1206 | GAAAAUGUUCUAGAUUUCUUU | 1534 |
| AM13599-SS | (NAG37)s(invAb)sagugcuggAfUfGfagugaaguuas(invAb) | 1207 | AGUGCUGGAUGAGUGAAGUUA | 1535 |
| AM13601-SS | (NAG37)s(invAb)sgugcuigaUfGfAfgugaaguugas(invAb) | 1208 | GUGCUIGAUGAGUGAAGUUGA | 1536 |
| AM13603-SS | (NAG37)s(invAb)sugcuggauGfAfGfugaaguuicas(invAb) | 1209 | UGCUGGAUGAGUGAAGUUICA | 1537 |
| AM13647-SS | (NAG37)s(invAb)sgaugcucuCfcAfaGfuaugaucas(invAb) | 1210 | GAUGCUCUCCAAGUAUGAUCA | 1538 |
| AM13649-SS | (NAG37)s(invAb)sgugaucguCfuGfcAfgaacaagas(invAb) | 1211 | GUGAUCGUCUGCAGAACAAGA | 1539 |
| AM13651-SS | (NAG37)s(invAb)sgucgucugCfaGfaAfcaagaucas(invAb) | 1212 | GUCGUCUGCAGAACAAGAUCA | 1540 |
| AM13653-SS | (NAG37)s(invAb)sgucgccagUfgCfaAfcuuuacuas(invAb) | 1213 | GUCGCCAGUGCAACUUUACUA | 1541 |
| AM13655-SS | (NAG37)s(invAb)saggauaAfgGfuUfacuuguguuas(invAb) | 1214 | AGGAUAAGGUUACUUGUGUUA | 1542 |
| AM13657-SS | (NAG37)s(invAb)saccagccaUfuAfuCfacaauugas(invAb) | 1215 | ACCAGCCAUUAUCACAAUUGA | 1543 |
| AM13659-SS | (NAG37)s(invAb)scaagcucuCfaGfuAfucaugcuas(invAb) | 1216 | CAAGCUCUCAGUAUCAUGCUA | 1544 |
| AM13661-SS | (NAG37)s(invAb)sgaagagugAfgGfuUfgacaaguus(invAb) | 1217 | GAAGAGUGAGGUUGACAAGUU | 1545 |
| AM13663-SS | (NAG37)s(invAb)sgagagugaGfGfUfugacaaguuas(invAb) | 1218 | GAGAGUGAGGUUGACAAGUUA | 1546 |
| AM13665-SS | (NAG37)s(invAb)sguucaacaAfGfGfagaauuguuas(invAb) | 1219 | GUUCAACAAGGAGAAUUGUUA | 1547 |
| AM13667-SS | (NAG37)s(invAb)sggaacaUfaCfcAfcagaacaugas(invAb) | 1220 | GGAACAUACCACAGAACAUGA | 1548 |
| AM13669-SS | (NAG37)s(invAb)sgaacauggAfuCfuAfuuaaaguas(invAb) | 1221 | GAACAUGGAUCUAUUAAAGUA | 1549 |
| AM13671-SS | (NAG37)s(invAb)sgacauggaUfcUfaUfuaaagucas(invAb) | 1222 | GACAUGGAUCUAUUAAAGUCA | 1550 |
| AM13673-SS | (NAG37)s(invAb)sugccuaAfaUfgGfugaauaugcas(invAb) | 1223 | UGCCUAAAUGGUGAAUAUGCA | 1551 |
| AM13675-SS | (NAG37)s(invAb)sgaaccucuAfGfAfagcuuaaacas(invAb) | 1224 | GAACCUCUAGAAGCUUAAACA | 1552 |
| AM13677-SS | (NAG37)s(invAb)sggccuucaAfaCfcAfaugaacaas(invAb) | 1225 | GGCCUUCAAACCAAUGAACAA | 1553 |
| AM13679-SS | (NAG37)s(invAb)sccaaugAfaCfaGfcaaagcauaas(invAb) | 1226 | CCAAUGAACAGCAAAGCAUAA | 1554 |
| AM13681-SS | (NAG37)s(invAb)sgaugaacaGfcAfAfagcauaacas(invAb) | 1227 | GAUGAACAGCAAAGCAUAACA | 1555 |
| AM13683-SS | (NAG37)s(invAb)sgugaacagCfAfAfagcauaaccus(invAb) | 1228 | GUGAACAGCAAAGCAUAACCU | 1556 |
| AM13685-SS | (NAG37)s(invAb)sgaacagcaAfaGfcAfuaaccuuas(invAb) | 1229 | GAACAGCAAAGCAUAACCUUA | 1557 |
| AM13687-SS | (NAG37)s(invAb)sgcaaagcaUfAfAfccuugaaucus(invAb) | 1230 | GCAAAGCAUAACCUUGAAUCU | 1558 |
| AM13689-SS | (NAG37)s(invAb)sccaaccaaCfuCfaAfuuauugaas(invAb) | 1231 | CCAACCAACUCAAUUAUUGAA | 1559 |
| AM13691-SS | (NAG37)s(invAb)scuuccuguGfAfUfccauuuuacus(invAb) | 1232 | CUUCCUGUGAUCCAUUUUACU | 1560 |
| AM13693-SS | (NAG37)s(invAb)sgguuuucuUfAfCfugucauaugas(invAb) | 1233 | GGUUUUCUUACUGUCAUAUGA | 1561 |
| AM13695-SS | (NAG37)s(invAb)sgagaucgaGfAfAfugccuuccaas(invAb) | 1234 | GAGAUCGAGAAUGCCUUCCAA | 1562 |
| AM13697-SS | (NAG37)s(invAb)sgacuggcaUfUfUfucaaugaugas(invAb) | 1235 | GACUGGCAUUUUCAAUGAUGA | 1563 |
| AM13699-SS | (NAG37)s(invAb)sgucaaugaUfGfAfaacugucuuus(invAb) | 1236 | GUCAAUGAUGAAACUGUCUUU | 1564 |
| AM13701-SS | (NAG37)s(invAb)sgaggaugaGfGfUfuacuuguguus(invAb) | 1237 | GAGGAUGAGGUUACUUGUGUU | 1565 |
| AM13703-SS | (NAG37)s(invAb)scugaagcuGfAfCfaauguugucus(invAb) | 1238 | CUGAAGCUGACAAUGUUGUCU | 1566 |

TABLE 4-continued

XDH RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM13705-SS | (NAG37)s(invAb)sgcuuuauuGfCfAfaagauguugas(invAb) | 1239 | GCUUUAUUGCAAAGAUGUUGA | 1567 |
| AM13707-SS | (NAG37)s(invAb)sgaggauuuGfUfAfagacuaaucus(invAb) | 1240 | GAGGAUUUGUAAGACUAAUCU | 1568 |
| AM13709-SS | (NAG37)s(invAb)sccgacuaaGfUfUfuggaauaagas(invAb) | 1241 | CCGACUAAGUUUGGAAUAAGA | 1569 |
| AM13711-SS | (NAG37)s(invAb)sgcuucacaCfUfUfucuuuucugas(invAb) | 1242 | GCUUCACACUUUCUUUUCUGA | 1570 |
| AM13713-SS | (NAG37)s(invAb)sgcagcuuuGfAfGfacaaacucuas(invAb) | 1243 | GCAGCUUUGAGACAAACUCUA | 1571 |
| AM13715-SS | (NAG37)s(invAb)sgagaaauuGfAfCfugcuuaacaas(invAb) | 1244 | GAGAAAUUGACUGCUUAACAA | 1572 |
| AM13717-SS | (NAG37)s(invAb)sccguaguaUfCfCfagauuuccaas(invAb) | 1245 | CCGUAGUAUCCAGAUUUCCAA | 1573 |
| AM13719-SS | (NAG37)s(invAb)sagcaggauGfGfCfauuuucaagas(invAb) | 1246 | AGCAGGAUGGCAUUUUCAAGA | 1574 |
| AM13721-SS | (NAG37)s(invAb)sgacaauugUfGfAfuccaaaucaus(invAb) | 1247 | GACAAUUGUGAUCCAAAUCAU | 1575 |
| AM13723-SS | (NAG37)s(invAb)suggcaguuUfUfGfaguaauucuas(invAb) | 1248 | UGGCAGUUUUGAGUAAUUCUA | 1576 |
| AM13725-SS | (NAG37)s(invAb)sgucugaguCfCfAfuuuuugaucas(invAb) | 1249 | GUCUGAGUCCAUUUUUGAUCA | 1577 |
| AM13727-SS | (NAG37)s(invAb)scuagaucuGfCfAfugcuuucuuas(invAb) | 1250 | CUAGAUCUGCAUGCUUUCUUA | 1578 |
| AM13729-SS | (NAG37)s(invAb)scuucagagAfGfCfuuauaucugas(invAb) | 1251 | CUUCAGAGAGCUUAUAUCUGA | 1579 |
| AM13746-SS | (NAG37)s(invAb)sggauacAfaGfgUfuggcuucauas(invAb) | 1252 | GGAUACAAGGUUGGCUUCAUA | 1520 |
| AM13750-SS | (NAG37)s(invAb)sggauacAfaGfgUfugicuucauas(invAb) | 1253 | GGAUACAAGGUUGICUUCAUA | 1580 |
| AM13751-SS | (NAG37)s(invAb)sggauacAfaGfgUfuigcuucauas(invAb) | 1254 | GGAUACAAGGUUIGCUUCAUA | 1581 |
| AM13752-SS | (NAG37)s(invAb)sggauacAfaGfgUfugguuucauas(invAb) | 1255 | GGAUACAAGGUUGGUUUCAUA | 1582 |
| AM13756-SS | (NAG37)s(invAb)sggauacaaGfgUfUfggcuucauas(invAb) | 1256 | GGAUACAAGGUUGGCUUCAUA | 1520 |
| AM13757-SS | (NAG37)s(invAb)sggauacaaGfgUfuGfgcuucauas(invAb) | 1257 | GGAUACAAGGUUGGCUUCAUA | 1520 |
| AM13760-SS | (NAG37)s(invAb)sgcaagguuGfgCfuUfcaugaagas(invAb) | 1258 | GCAAGGUUGGCUUCAUGAAGA | 1521 |
| AM13857-SS | (NAG37)s(invAb)sguggagaaAfAfAfugcaiauccas(invAb) | 1259 | GUGGAGAAAAAUGCAIAUCCA | 1583 |
| AM13859-SS | (NAG37)s(invAb)succagagaCfAfAfcucuuuuggas(invAb) | 1260 | UCCAGAGACAACUCUUUUGGA | 1584 |
| AM13861-SS | (NAG37)s(invAb)scucuccaaGfUfAfugauciucuas(invAb) | 1261 | CUCUCCAAGUAUGAUCIUCUA | 1585 |
| AM13863-SS | (NAG37)s(invAb)sgcaacuguGfGfAfaggaauaggas(invAb) | 1262 | GCAACUGUGGAAGGAAUAGGA | 1586 |
| AM13865-SS | (NAG37)s(invAb)suggcaucgUfCfAfugaguauguas(invAb) | 1263 | UGGCAUCGUCAUGAGUAUGUA | 1587 |
| AM13867-SS | (NAG37)s(invAb)sgccuuccaAfGfGfaaaucuguias(invAb) | 1264 | GCCUUCCAAGGAAAUCUGUIA | 1588 |
| AM13869-SS | (NAG37)s(invAb)sguggcauuGfAfGfaugaaguucas(invAb) | 1265 | GUGGCAUUGAGAUGAAGUUCA | 1589 |
| AM13871-SS | (NAG37)s(invAb)sga_2NugaaguUfCfAfagaauaugcus(invAb) | 1266 | G($A^{2N}$)UGAAGUUCAAGAAUAUGCU | 1590 |
| AM13873-SS | (NAG37)s(invAb)sggaauaugCfUfGfuuuccuaugas(invAb) | 1267 | GGAAUAUGCUGUUUCCUAUGA | 1591 |
| AM13875-SS | (NAG37)s(invAb)sgcugcucuCfCfAfuagaiauccas(invAb) | 1268 | GCUGCUCUCCAUAGAIAUCCA | 1592 |
| AM13877-SS | (NAG37)s(invAb)sgaguauuuCfUfCfagcauucaaas(invAb) | 1269 | GAGUAUUUCUCAGCAUUCAAA | 1593 |
| AM13879-SS | (NAG37)s(invAb)scgccaagaUfCfAfaguccauagas(invAb) | 1270 | CGCCAAGAUCAAGUCCAUAGA | 1594 |
| AM13881-SS | (NAG37)s(invAb)succaggguUfUfGfuuuguuucaus(invAb) | 1271 | UCCAGGGUUUGUUUGUUUCAU | 1595 |
| AM13883-SS | (NAG37)s(invAb)sgucaccuaUfGfAfagaacuaccas(invAb) | 1272 | GUCACCUAUGAAGAACUACCA | 1596 |
| AM13885-SS | (NAG37)s(invAb)sgagaacuaCfCfAfgccauuaucas(invAb) | 1273 | GAGAACUACCAGCCAUUAUCA | 1597 |
| AM13887-SS | (NAG37)s(invAb)scagccauuAfUfCfacaauugagas(invAb) | 1274 | CAGCCAUUAUCACAAUUGAGA | 1598 |
| AM13889-SS | (NAG37)s(invAb)sugagcugaAfGfAfucgagaaagas(invAb) | 1275 | UGAGCUGAAGAUCGAGAAAGA | 1599 |

TABLE 4-continued

XDH RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM13891-SS | (NAG37)s(invAb)scugcaccaUfUfGfcuguuccaaas(invAb) | 1276 | CUGCACCAUUGCUGUUCCAAA | 1600 |
| AM13893-SS | (NAG37)s(invAb)sguggagcuCfUfUfuguguuuacas(invAb) | 1277 | GUGGAGCUCUUUGUGUUUACA | 1601 |
| AM13895-SS | (NAG37)s(invAb)sagcucuuuGfUfGfucuacacaias(invAb) | 1278 | AGCUCUUUGUGUCUACACAIA | 1602 |
| AM13897-SS | (NAG37)s(invAb)scucucucaGfAfGfuauuauggaas(invAb) | 1279 | CUCUCUCAGAGUAUUAUGGAA | 1603 |
| AM13899-SS | (NAG37)s(invAb)sgcagaguaUfUfAfuggaacgaias(invAb) | 1280 | GCAGAGUAUUAUGGAACGAIA | 1604 |
| AM14174-SS | (NAG37)s(invAb)succaggguUfUfGfuuuguuucaas(invAb) | 1281 | UCCAGGGUUUGUUUGUUUCAA | 1605 |
| AM14203-SS | (NAG37)s(invAb)sccaggguuUfGfUfuuguuucauus(invAb) | 1282 | CCAGGGUUUGUUUGUUUCAUU | 1606 |
| AM14205-SS | (NAG37)s(invAb)scaggguuuGfUfUfuguuucauuus(invAb) | 1283 | CAGGGUUUGUUUGUUUCAUUU | 1607 |
| AM14207-SS | (NAG37)s(invAb)sggguuuguUfUfGfuuucauuucas(invAb) | 1284 | GGGUUUGUUUGUUUCAUUUCA | 1608 |
| AM14213-SS | (NAG37)s(invAb)succaggguUfuGfuUfuguuucaas(invAb) | 1285 | UCCAGGGUUUGUUUGUUUCAA | 1605 |
| AM14214-SS | (NAG37)s(invAb)succaggguUfuGfUfuuguuucaas(invAb) | 1286 | UCCAGGGUUUGUUUGUUUCAA | 1605 |
| AM14215-SS | (NAG37)s(invAb)sgcucuccaAfGfUfaugauciucus(invAb) | 1287 | GCUCUCCAAGUAUGAUCIUCU | 1609 |
| AM14217-SS | (NAG37)s(invAb)sggaggagaUfUfGfagaauiccuus(invAb) | 1288 | GGAGGAGAUUGAGAAUICCUU | 1610 |
| AM14219-SS | (NAG37)s(invAb)scgagaaugCfCfUfuccaaggaaas(invAb) | 1289 | CGAGAAUGCCUUCCAAGGAAA | 1611 |
| AM14221-SS | (NAG37)s(invAb)sgaugccuuCfCfAfaggaaaucuas(invAb) | 1290 | GAUGCCUUCCAAGGAAAUCUA | 1612 |
| AM14223-SS | (NAG37)s(invAb)sca_2NagaauaUfGfCfuguuuccuaus(invAb) | 1291 | C(A$^{2N}$)AGAAUAUGCUGUUUCCUAU | 1613 |
| AM14225-SS | (NAG37)s(invAb)scguuggagGfGfAfacaucaucaas(invAb) | 1292 | CGUUGGAGGGAACAUCAUCAA | 1614 |
| AM14227-SS | (NAG37)s(invAb)scagcuucuUfCfUfucaaguucuas(invAb) | 1293 | CAGCUUCUUCUUCAAGUUCUA | 1615 |
| AM14229-SS | (NAG37)s(invAb)sguguugggCfAfUfaucauuggua s(invAb) | 1294 | GUGUUGGGCAUAUCAUUGGUA | 1616 |
| AM14231-SS | (NAG37)s(invAb)scgucuacaCfAfGfaacaccaugas(invAb) | 1295 | CGUCUACACAGAACACCAUGA | 1617 |
| AM14233-SS | (NAG37)s(invAb)sgacacccaGfGfAfucucuuucaas(invAb) | 1296 | GACACCCAGGAUCUCUUUCAA | 1618 |
| AM14235-SS | (NAG37)s(invAb)sagcaagcuCfUfCfaguaucaugas(invAb) | 1297 | AGCAAGCUCUCAGUAUCAUGA | 1619 |
| AM14237-SS | (NAG37)s(invAb)sucggaagaGfUfGfagguugacaas(invAb) | 1298 | UCGGAAGAGUGAGGUUGACAA | 1620 |
| AM14239-SS | (NAG37)s(invAb)sgacaaggaGfAfAfuuguuggaaas(invAb) | 1299 | GACAAGGAGAAUUGUUGGAAA | 1621 |
| AM14241-SS | (NAG37)s(invAb)sgcagcuuuGfAfGfacuaacucaas(invAb) | 1300 | GCAGCUUUGAGACUAACUCAA | 1622 |
| AM14243-SS | (NAG37)s(invAb)sccuccgcaCfAfGfauauugucaus(invAb) | 1301 | CCUCCGCACAGAUAUUGUCAU | 1623 |
| AM14245-SS | (NAG37)s(invAb)succgcacaGfAfUfauugucaugas(invAb) | 1302 | UCCGCACAGAUAUUGUCAUGA | 1624 |
| AM14247-SS | (NAG37)s(invAb)sggcugcuuCfUfAfucuucuuugas(invAb) | 1303 | GGCUGCUUCUAUCUUCUUUGA | 1625 |
| AM14249-SS | (NAG37)s(invAb)sagcacacaGfGfUfaauaacguias(invAb) | 1304 | AGCACACAGGUAAUAACGUIA | 1626 |
| AM14251-SS | (NAG37)s(invAb)sccuguauaAfCfCfucaaguucuas(invAb) | 1305 | CCUGUAUAACCUCAAGUUCUA | 1627 |
| AM14253-SS | (NAG37)s(invAb)sgaccaaugAfAfCfagcaaagcaus(invAb) | 1306 | GACCAAUGAACAGCAAAGCAU | 1628 |
| AM14255-SS | (NAG37)s(invAb)sca_2NuaaccuUfGfAfaucuauacuas(invAb) | 1307 | C(A$^{2N}$)UAACCUUGAAUCUAUACUA | 1629 |
| AM14257-SS | (NAG37)s(invAb)sggcauaaaGfCfAfagauuacucus(invAb) | 1308 | GGCAUAAAGCAAGAUUACUCU | 1630 |
| AM14259-SS | (NAG37)s(invAb)succaccuaGfAfAfaugaugcuaus(invAb) | 1309 | UCCACCUAGAAAUGAUGCUAU | 1631 |
| AM14261-SS | (NAG37)s(invAb)scuagcucuGfUfCfucuucuiucus(invAb) | 1310 | CUAGCUCUGUCUCUUCUIUCU | 1632 |
| AM14263-SS | (NAG37)s(invAb)scua_2NaggcuUfGfGfuuuucuuacus(invAb) | 1311 | CU(A$^{2N}$)AGGCUUGGUUUUCUUACU | 1633 |

TABLE 4-continued

XDH RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM14284-SS | (NAG37)s(invAb)scucucucaGfaGfuAfuuauggaas(invAb) | 1312 | CUCUCUCAGAGUAUUAUGGAA | 1603 |
| AM14286-SS | (NAG37)s(invAb)scucucucaGfaGfUfauuauggaas(invAb) | 1313 | CUCUCUCAGAGUAUUAUGGAA | 1603 |
| AM14287-SS | (NAG37)s(invAb)scagugaugCfUfCfuccaaguauas(invAb) | 1314 | CAGUGAUGCUCUCCAAGUAUA | 1634 |
| AM14289-SS | (NAG37)s(invAb)sgccaaguaUfGfAfucgucuicaas(invAb) | 1315 | GCCAAGUAUGAUCGUCUICAA | 1635 |
| AM14291-SS | (NAG37)s(invAb)suggcaugaGfAfGfuuuuauucaas(invAb) | 1316 | UGGCAUGAGAGUUUUAUUCAA | 1636 |
| AM14294-SS | (NAG37)s(invAb)suggcaugaGfAfGfuuuua_2Nuucaas(invAb) | 1317 | UGGCAUGAGAGUUUU($A^{2N}$)UUCAA | 1637 |
| AM14295-SS | (NAG37)s(invAb)sccucagcuUfCfUfucuucaaguas(invAb) | 1318 | CCUCAGCUUCUUCUUCAAGUA | 1638 |
| AM14300-SS | (NAG37)s(invAb)sccucagcuUfCfUfucuuuaaguas(invAb) | 1319 | CCUCAGCUUCUUCUUUAAGUA | 1639 |
| AM14302-SS | (NAG37)s(invAb)sccucagcuUfcUfUfcuucaaguas(invAb) | 1320 | CCUCAGCUUCUUCUUCAAGUA | 1638 |
| AM14303-SS | (NAG37)s(invAb)sccucagcuUfcUfuCfuucaaguas(invAb) | 1321 | CCUCAGCUUCUUCUUCAAGUA | 1638 |
| AM14386-SS | (NAG37)s(invAb)sgaguauuuCfuCfAfgcauucaaas(invAb) | 1322 | GAGUAUUUCUCAGCAUUCAAA | 1593 |
| AM14390-SS | (NAG37)s(invAb)sgacaagauCfGfUfccacuuuucus(invAb) | 1323 | GACAAGAUCGUCCACUUUUCU | 1640 |
| AM14392-SS | (NAG37)s(invAb)saccauguuGfCfAfgugacaacuas(invAb) | 1324 | ACCAUGUUGCAGUGACAACUA | 1641 |
| AM14394-SS | (NAG37)s(invAb)sggugacaaCfUfGfuggaaggaaus(invAb) | 1325 | GGUGACAACUGUGGAAGGAAU | 1642 |
| AM14396-SS | (NAG37)s(invAb)sguggaggaGfAfUfugagaaugcas(invAb) | 1326 | GUGGAGGAGAUUGAGAAUGCA | 1643 |
| AM14398-SS | (NAG37)s(invAb)sgacacggaGfAfUfuggcauugaas(invAb) | 1327 | GACACGGAGAUUGGCAUUGAA | 1644 |
| AM14400-SS | (NAG37)s(invAb)scgagaugaAfGfUfucaagaaua_2Nus(invAb) | 1328 | CGAGAUGAAGUUCAAGAAU($A^{2N}$)U | 1645 |
| AM14402-SS | (NAG37)s(invAb)saggagauaCfUfGfcucuccauaas(invAb) | 1329 | AGGAGAUACUGCUCUCCAUAA | 1646 |
| AM14404-SS | (NAG37)s(invAb)sggggaguaUfUfUfcucagcauuas(invAb) | 1330 | GGGGAGUAUUUCUCAGCAUUA | 1647 |
| AM14406-SS | (NAG37)s(invAb)sgggaguauUfUfCfucagcauucas(invAb) | 1331 | GGGAGUAUUUCUCAGCAUUCA | 1648 |
| AM14408-SS | (NAG37)s(invAb)sccggagagAfAfGfaugacauugas(invAb) | 1332 | CCGGAGAGAAGAUGACAUUGA | 1649 |
| AM14410-SS | (NAG37)s(invAb)sgguaacauAfAfCfuggaauuugus(invAb) | 1333 | GGUAACAUAACUGGAAUUUGU | 1650 |
| AM14412-SS | (NAG37)s(invAb)sccagccauUfAfUfcacaauugaas(invAb) | 1334 | CCAGCCAUUAUCACAAUUGAA | 1651 |
| AM14414-SS | (NAG37)s(invAb)sgagcuuugUfUfGfcaaaaauguus(invAb) | 1335 | GAGCUUUGUUGCAAAAAUGUU | 1652 |
| AM14416-SS | (NAG37)s(invAb)sgcuuuguuGfCfAfaaaauguugas(invAb) | 1336 | GCUUUGUUGCAAAAAUGUUGA | 1653 |
| AM14418-SS | (NAG37)s(invAb)scggauuguGfGfUfucgagugaaas(invAb) | 1337 | CGGAUUGUGGUUCGAGUGAAA | 1654 |
| AM14525-SS | (NAG37)s(invAb)scccaccaaGfuUfuGfgaauaagas(invAb) | 1338 | CCCACCAAGUUUGGAAUAAGA | 1531 |
| AM14526-SS | (NAG37)s(invAb)scccaccaaGfuUfUfggaauaagas(invAb) | 1339 | CCCACCAAGUUUGGAAUAAGA | 1531 |
| AM14528-SS | (NAG37)s(invAb)sugccuaaaUfgGfuGfaauaugcas(invAb) | 1340 | UGCCUAAAUGGUGAAUAUGCA | 1551 |
| AM14531-SS | (NAG37)s(invAb)sugccuaaaUfgGfUfgaauaugcas(invAb) | 1341 | UGCCUAAAUGGUGAAUAUGCA | 1551 |
| AM14646-SS | (NAG37)s(invAb)succaggguUfuGfuUfuguuucaus(invAb) | 1342 | UCCAGGGUUUGUUUGUUUCAU | 1595 |
| AM15136-SS | (NAG37)s(invAb)sgucucucaGfaGfuAfuuauggaas(invAb) | 1343 | GUCUCUCAGAGUAUUAUGGAA | 1655 |
| AM15138-SS | (NAG37)s(invAb)scccucucaGfaGfuAfuuauggaas(invAb) | 1344 | CCCUCUCAGAGUAUUAUGGAA | 1656 |
| AM15140-SS | (NAG37)s(invAb)sgccucucaGfaGfuAfuuauggaas(invAb) | 1345 | GUCUCUCAGAGUAUUAUGGAA | 1657 |
| AM15142-SS | (NAG37)s(invAb)saccucucaGfaGfuAfuuauggaas(invAb) | 1346 | ACCUCUCAGAGUAUUAUGGAA | 1658 |
| AM15144-SS | (NAG37)s(invAb)succucucaGfaGfuAfuuauggaas(invAb) | 1347 | UCCUCUCAGAGUAUUAUGGAA | 1659 |
| AM15284-SS | (NAG37)s(invAb)sccuccgcaCfaGfaUfauugucaus(invAb) | 1348 | CCUCCGCACAGAUAUUGUCAU | 1623 |

TABLE 4-continued

XDH RNAi Agent Sense Strand Sequences

| Sense Strand ID: | Modified Sense Strand (5'→3') | SEQ ID NO. | Underlying Base Sequence (5'→3') (Shown as an Unmodified Nucleotide Sequence) | SEQ ID NO. |
|---|---|---|---|---|
| AM15288-SS | (NAG37)s(invAb)sccuccgcaCfaGfaUfauugucaas(invAb) | 1349 | CCUCCGCACAGAUAUUGUCAA | 1660 |
| AM15293-SS | (NAG37)s(invAb)scuccgcaCfaGfaUfauugucaus(invAb) | 1350 | CUCCGCACAGAUAUUGUCAU | 1661 |
| AM15295-SS | (NAG37)s(invAb)succgcaCfaGfaUfauugucaus(invAb) | 1351 | UCCGCACAGAUAUUGUCAU | 1662 |
| AM17242-SS | (NAG37)suscagagUfaUfUfAfuggaacgagus(invAb) | 1676 | UCAGAGUAUUAUGGAACGAGU | 1678 |
| AM17244-SS | (NAG37)scsucucuCfaGfAfGfuauuauggaus(invAb) | 1677 | CUCUCUCAGAGUAUUAUGGAU | 1679 |

($A^{2N}$) = 2-aminoadenine nucleotide;
I = hypoxanthine (inosine) nucleotide

The XDH RNAi agents described herein are formed by annealing an antisense strand with a sense strand. A sense strand containing a sequence listed in Table 2, Table 4, or Table 5C can be hybridized to any antisense strand containing a sequence listed in Table 2, Table 3, or Table 5C provided the two sequences have a region of at least 85% complementarity over a contiguous 15, 16, 17, 18, 19, 20, or 21 nucleotide sequence.

In some aspects, the antisense strand of an XDH RNAi agent disclosed herein differs by 0, 1, 2, or 3 nucleotides from any of the antisense strand sequences in Table 3 or Table 5C. In some aspects, the sense strand of an XDH RNAi agent disclosed herein differs by 0, 1, 2, or 3 nucleotides from any of the sense strand sequences in Table 4 or Table 5C.

In some aspects, an XDH RNAi agent antisense strand comprises a nucleotide sequence of any of the sequences in Table 2, Table 3, or Table 5C. In some aspects, an XDH RNAi agent antisense strand comprises the sequence of nucleotides (from 5' end→3' end) at positions 1-17, 2-17, 1-18, 2-18, 1-19, 2-19, 1-20, 2-20, 1-21, or 2-21, of any of the sequences in Table 2, Table 3, or Table 5C. In certain aspects, an XDH RNAi agent antisense strand comprises or consists of a modified sequence of any one of the modified sequences in Table 3 or Table 5C.

In some aspects, an XDH RNAi agent sense strand comprises the nucleotide sequence of any of the sequences in Table 2, Table 4, or Table 5C. In some aspects, an XDH RNAi agent sense strand comprises the sequence of nucleotides (from 5' end→3' end) at positions 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, or 4-21, of any of the sequences in Table 2, Table 4, or Table 5C. In certain aspects, an XDH RNAi agent sense strand comprises or consists of a modified sequence of any one of the modified sequences in Table 4 or Table 5C.

For the XDH RNAi agents disclosed herein, the nucleotide at position 1 of the antisense strand (from 5' end→3' end) can be perfectly complementary to an XDH gene, or can be non-complementary to an XDH gene. In some aspects, the nucleotide at position 1 of the antisense strand (from 5' end→3' end) is a U, A, or dT (or a modified version thereof). In some aspects, the nucleotide at position 1 of the antisense strand (from 5' end→3' end) forms an A:U or U:A base pair with the sense strand.

A sense strand containing a sequence listed in Table 2, Table 4, or Table 5C can be hybridized to any antisense strand containing a sequence listed in Table 2. Table 3, or Table 5C, provided the two sequences have a region of at least 85% complementarity over a contiguous 16, 17, 18, 19, 20, or 21 nucleotide sequence. In some aspects, the XDH RNAi agent has a sense strand consisting of the modified sequence of any of the modified sequences in Table 4 or Table 5C, and an antisense strand consisting of the modified sequence of any of the modified sequences in Table 3 or Table 5C. Certain representative sequence pairings are exemplified by the Duplex ID Nos. shown in Tables 5A, 5B, and 5C.

In some aspects, an XDH RNAi agent comprises, consists of, or consists essentially of a duplex represented by any one of the Duplex ID Nos. presented herein. In some aspects, an XDH RNAi agent comprises the sense strand and antisense strand nucleotide sequences of any of the duplexes represented by any of the Duplex ID NOs. presented herein. In some aspects, an XDH RNAi agent comprises the sense strand and antisense strand nucleotide sequences of any of the duplexes represented by any of the Duplex ID NOs. presented herein and a targeting group and/or linking group wherein the targeting group and/or linking group is covalently linked (i.e., conjugated) to the sense strand or the antisense strand. In some aspects, an XDH RNAi agent includes the sense strand and antisense strand modified nucleotide sequences of any of the Duplex ID NOs. presented herein. In some aspects, an XDH RNAi agent comprises the sense strand and antisense strand modified nucleotide sequences of any of the Duplex ID NOs. presented herein and a targeting group and/or linking group, wherein the targeting group and/or linking group is covalently linked to the sense strand or the antisense strand.

In some aspects, an XDH RNAi agent comprises an antisense strand and a sense strand having the nucleotide sequences of any of the antisense strand/sense strand duplexes of Table 2 or Tables 5A, 5B, and 5C, and further comprises a targeting group or targeting ligand. In some aspects, an XDH RNAi agent comprises an antisense strand and a sense strand having the nucleotide sequences of any of the antisense strand/sense strand duplexes of Table 2 or Tables 5A, 5B, and 5C, and further comprises an asialoglycoprotein receptor ligand targeting group.

A targeting group, with or without a linker, can be linked to the 5' or 3' end of any of the sense and/or antisense strands disclosed in Tables 2, 3, 4, or 5C. A linker, with or without a targeting group, can be attached to the 5' or 3' end of any of the sense and/or antisense strands disclosed in Tables 2, 3, 4, and 5C.

In some aspects, an XDH RNAi agent comprises an antisense strand and a sense strand having the nucleotide sequences of any of the antisense strand/sense strand duplexes of Table 2 or Tables 5A, 5B and 5C, and further comprises a targeting ligand selected from the group consisting of: (NAG37) and (NAG37)s, each as defined in Table 6.

In some aspects, an XDH RNAi agent comprises an antisense strand and a sense strand having the modified nucleotide sequence of any of the antisense strand and/or sense strand nucleotide sequences in Table 3 or Table 4.

In some aspects, an XDH RNAi agent comprises an antisense strand and a sense strand having a modified nucleotide sequence of any of the antisense strand and/or sense strand nucleotide sequences of any of the duplexes Tables 5A, 5B, and 5C, and further comprises an asialoglycoprotein receptor ligand targeting group.

In some aspects, an XDH RNAi agent comprises, consists of, or consists essentially of any of the duplexes of Tables 5A, 5B, and 5C.

TABLE 5A

XDH RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD09217 | AM13029-AS | 945 | 1352 | AM13028-SS | 1175 | 1506 |
| AD09218 | AM13031-AS | 946 | 1352 | AM13030-SS | 1176 | 1506 |
| AD09219 | AM13033-AS | 947 | 1353 | AM13032-SS | 1177 | 1507 |
| AD09220 | AM13035-AS | 948 | 1354 | AM13034-SS | 1178 | 1508 |
| AD09221 | AM13037-AS | 949 | 1355 | AM13036-SS | 1179 | 1509 |
| AD09222 | AM13039-AS | 950 | 1356 | AM13038-SS | 1180 | 1510 |
| AD09223 | AM13041-AS | 951 | 1357 | AM13040-SS | 1181 | 1511 |
| AD09224 | AM13043-AS | 952 | 1358 | AM13042-SS | 1182 | 1512 |
| AD09225 | AM13045-AS | 953 | 1359 | AM13044-SS | 1183 | 1513 |
| AD09226 | AM13047-AS | 954 | 1360 | AM13046-SS | 1184 | 1514 |
| AD09227 | AM13049-AS | 955 | 1361 | AM13048-SS | 1185 | 1515 |
| AD09228 | AM13051-AS | 956 | 1362 | AM13050-SS | 1186 | 1516 |
| AD09229 | AM13053-AS | 957 | 1363 | AM13052-SS | 1187 | 1517 |
| AD09230 | AM13055-AS | 958 | 1364 | AM13054-SS | 1188 | 1518 |
| AD09231 | AM13057-AS | 959 | 1365 | AM13056-SS | 1189 | 1519 |
| AD09232 | AM13059-AS | 960 | 1366 | AM13058-SS | 1190 | 1520 |
| AD09233 | AM13061-AS | 961 | 1367 | AM13060-SS | 1191 | 1521 |
| AD09234 | AM13063-AS | 962 | 1368 | AM13062-SS | 1192 | 1522 |
| AD09235 | AM13065-AS | 963 | 1369 | AM13064-SS | 1193 | 1523 |
| AD09236 | AM13067-AS | 964 | 1370 | AM13066-SS | 1194 | 1524 |
| AD09237 | AM13069-AS | 965 | 1371 | AM13068-SS | 1195 | 1525 |
| AD09238 | AM13071-AS | 966 | 1372 | AM13070-SS | 1196 | 1526 |
| AD09239 | AM13073-AS | 967 | 1373 | AM13072-SS | 1197 | 1527 |
| AD09302 | AM13164-AS | 968 | 1374 | AM13163-SS | 1198 | 1528 |
| AD09303 | AM13166-AS | 969 | 1375 | AM13165-SS | 1199 | 1529 |
| AD09304 | AM13168-AS | 970 | 1376 | AM13167-SS | 1200 | 1530 |
| AD09305 | AM13170-AS | 971 | 1377 | AM13169-SS | 1201 | 1531 |
| AD09306 | AM13172-AS | 972 | 1378 | AM13171-SS | 1202 | 1532 |
| AD09307 | AM13174-AS | 973 | 1379 | AM13173-SS | 1203 | 1533 |
| AD09308 | AM13176-AS | 974 | 1374 | AM13175-SS | 1204 | 1528 |
| AD09309 | AM13177-AS | 975 | 1375 | AM13165-SS | 1199 | 1529 |
| AD09310 | AM13179-AS | 976 | 1376 | AM13178-SS | 1205 | 1530 |
| AD09311 | AM13181-AS | 977 | 1380 | AM13180-SS | 1206 | 1534 |
| AD09323 | AM13204-AS | 978 | 1374 | AM13163-SS | 1198 | 1528 |
| AD09324 | AM13205-AS | 979 | 1376 | AM13167-SS | 1200 | 1530 |
| AD09325 | AM13206-AS | 980 | 1377 | AM13169-SS | 1201 | 1531 |
| AD09326 | AM13207-AS | 981 | 1378 | AM13171-SS | 1202 | 1532 |
| AD09571 | AM13600-AS | 982 | 1381 | AM13599-SS | 1207 | 1535 |
| AD09572 | AM13602-AS | 983 | 1382 | AM13601-SS | 1208 | 1536 |
| AD09573 | AM13604-AS | 984 | 1383 | AM13603-SS | 1209 | 1537 |
| AD09598 | AM13648-AS | 985 | 1384 | AM13647-SS | 1210 | 1538 |
| AD09599 | AM13650-AS | 986 | 1385 | AM13649-SS | 1211 | 1539 |
| AD09600 | AM13652-AS | 987 | 1386 | AM13651-SS | 1212 | 1540 |
| AD09601 | AM13654-AS | 988 | 1387 | AM13653-SS | 1213 | 1541 |
| AD09602 | AM13656-AS | 989 | 1388 | AM13655-SS | 1214 | 1542 |
| AD09603 | AM13658-AS | 990 | 1389 | AM13657-SS | 1215 | 1543 |
| AD09604 | AM13660-AS | 991 | 1390 | AM13659-SS | 1216 | 1544 |
| AD09605 | AM13662-AS | 992 | 1391 | AM13661-SS | 1217 | 1545 |
| AD09606 | AM13664-AS | 993 | 1392 | AM13663-SS | 1218 | 1546 |
| AD09607 | AM13666-AS | 994 | 1393 | AM13665-SS | 1219 | 1547 |
| AD09608 | AM13668-AS | 995 | 1394 | AM13667-SS | 1220 | 1548 |
| AD09609 | AM13670-AS | 996 | 1395 | AM13669-SS | 1221 | 1549 |
| AD09610 | AM13672-AS | 997 | 1396 | AM13671-SS | 1222 | 1550 |
| AD09611 | AM13674-AS | 998 | 1397 | AM13673-SS | 1223 | 1551 |
| AD09612 | AM13676-AS | 999 | 1398 | AM13675-SS | 1224 | 1552 |
| AD09613 | AM13678-AS | 1000 | 1399 | AM13677-SS | 1225 | 1553 |
| AD09614 | AM13680-AS | 1001 | 1400 | AM13679-SS | 1226 | 1554 |
| AD09615 | AM13682-AS | 1002 | 1401 | AM13681-SS | 1227 | 1555 |

TABLE 5A-continued

XDH RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD09616 | AM13684-AS | 1003 | 1402 | AM13683-SS | 1228 | 1556 |
| AD09617 | AM13686-AS | 1004 | 1403 | AM13685-SS | 1229 | 1557 |
| AD09618 | AM13688-AS | 1005 | 1404 | AM13687-SS | 1230 | 1558 |
| AD09619 | AM13690-AS | 1006 | 1405 | AM13689-SS | 1231 | 1559 |
| AD09620 | AM13692-AS | 1007 | 1406 | AM13691-SS | 1232 | 1560 |
| AD09621 | AM13694-AS | 1008 | 1407 | AM13693-SS | 1233 | 1561 |
| AD09623 | AM13696-AS | 1009 | 1408 | AM13695-SS | 1234 | 1262 |
| AD09624 | AM13698-AS | 1010 | 1409 | AM13697-SS | 1235 | 1563 |
| AD09625 | AM13700-AS | 1011 | 1410 | AM13699-SS | 1236 | 1564 |
| AD09626 | AM13702-AS | 1012 | 1411 | AM13701-SS | 1237 | 1565 |
| AD09627 | AM13704-AS | 1013 | 1412 | AM13703-SS | 1238 | 1566 |
| AD09628 | AM13706-AS | 1014 | 1413 | AM13705-SS | 1239 | 1567 |
| AD09629 | AM13708-AS | 1015 | 1414 | AM13707-SS | 1240 | 1568 |
| AD09630 | AM13710-AS | 1016 | 1415 | AM13709-SS | 1241 | 1569 |
| AD09631 | AM13712-AS | 1017 | 1416 | AM13711-SS | 1242 | 1570 |
| AD09632 | AM13714-AS | 1018 | 1417 | AM13713-SS | 1243 | 1571 |
| AD09633 | AM13716-AS | 1019 | 1418 | AM13715-SS | 1244 | 1572 |
| AD09634 | AM13718-AS | 1020 | 1419 | AM13717-SS | 1245 | 1573 |
| AD09635 | AM13720-AS | 1021 | 1420 | AM13719-SS | 1246 | 1574 |
| AD09636 | AM13722-AS | 1022 | 1421 | AM13721-SS | 1247 | 1575 |
| AD09637 | AM13724-AS | 1023 | 1422 | AM13723-SS | 1248 | 1576 |
| AD09638 | AM13726-AS | 1024 | 1423 | AM13725-SS | 1249 | 1577 |
| AD09639 | AM13728-AS | 1025 | 1424 | AM13727-SS | 1250 | 1578 |
| AD09640 | AM13730-AS | 1026 | 1425 | AM13729-SS | 1251 | 1579 |
| AD09650 | AM13747-AS | 1027 | 1366 | AM13746-SS | 1252 | 1520 |
| AD09651 | AM13748-AS | 1028 | 1366 | AM13746-SS | 1252 | 1520 |
| AD09652 | AM13749-AS | 1029 | 1366 | AM13746-SS | 1252 | 1520 |
| AD09653 | AM13748-AS | 1028 | 1366 | AM13750-SS | 1253 | 1580 |
| AD09654 | AM13748-AS | 1028 | 1366 | AM13751-SS | 1254 | 1581 |
| AD09655 | AM13748-AS | 1028 | 1366 | AM13752-SS | 1255 | 1582 |
| AD09656 | AM13753-AS | 1030 | 1426 | AM13746-SS | 1252 | 1520 |
| AD09657 | AM13754-AS | 1031 | 1427 | AM13746-SS | 1252 | 1520 |
| AD09658 | AM13755-AS | 1032 | 1366 | AM13746-SS | 1252 | 1520 |
| AD09659 | AM13748-AS | 1028 | 1366 | AM13058-SS | 1190 | 1520 |
| AD09660 | AM13748-AS | 1028 | 1366 | AM13756-SS | 1256 | 1520 |
| AD09661 | AM13748-AS | 1028 | 1366 | AM13757-SS | 1257 | 1520 |
| AD09662 | AM13758-AS | 1028 | 1366 | AM13060-SS | 1191 | 1521 |
| AD09663 | AM13759-AS | 1034 | 1367 | AM13060-SS | 1191 | 1521 |
| AD09664 | AM13758-AS | 1033 | 1367 | AM13760-SS | 1258 | 1521 |
| AD09665 | AM13761-AS | 1035 | 1367 | AM13760-SS | 1258 | 1521 |
| AD09724 | AM13858-AS | 1036 | 1428 | AM13857-SS | 1259 | 1583 |
| AD09725 | AM13860-AS | 1037 | 1429 | AM13859-SS | 1260 | 1584 |
| AD09726 | AM13862-AS | 1038 | 1430 | AM13861-SS | 1261 | 1585 |
| AD09727 | AM13864-AS | 1039 | 1431 | AM13863-SS | 1262 | 1586 |
| AD09728 | AM13866-AS | 1040 | 1432 | AM13865-SS | 1263 | 1587 |
| AD09729 | AM13868-AS | 1041 | 1433 | AM13867-SS | 1264 | 1588 |
| AD09730 | AM13870-AS | 1042 | 1434 | AM13869-SS | 1265 | 1589 |
| AD09731 | AM13872-AS | 1043 | 1435 | AM13871-SS | 1266 | 1590 |
| AD09732 | AM13874-AS | 1044 | 1436 | AM13873-SS | 1267 | 1591 |
| AD09733 | AM13876-AS | 1045 | 1437 | AM13875-SS | 1268 | 1592 |
| AD09734 | AM13878-AS | 1046 | 1438 | AM13877-SS | 1269 | 1593 |
| AD09735 | AM13880-AS | 1047 | 1439 | AM13879-SS | 1270 | 1594 |
| AD09736 | AM13882-AS | 1048 | 1440 | AM13881-SS | 1271 | 1595 |
| AD09737 | AM13884-AS | 1049 | 1441 | AM13883-SS | 1272 | 1596 |
| AD09738 | AM13886-AS | 1050 | 1442 | AM13885-SS | 1273 | 1597 |
| AD09739 | AM13888-AS | 1051 | 1443 | AM13887-SS | 1274 | 1598 |
| AD09740 | AM13890-AS | 1052 | 1444 | AM13889-SS | 1275 | 1599 |
| AD09741 | AM13892-AS | 1053 | 1445 | AM13891-SS | 1276 | 1600 |
| AD09742 | AM13894-AS | 1054 | 1446 | AM13893-SS | 1277 | 1601 |
| AD09743 | AM13896-AS | 1055 | 1447 | AM13895-SS | 1278 | 1602 |
| AD09744 | AM13898-AS | 1056 | 1448 | AM13897-SS | 1279 | 1603 |
| AD09745 | AM13900-AS | 1057 | 1449 | AM13899-SS | 1280 | 1604 |
| AD09937 | AM14175-AS | 1058 | 1450 | AM14174-SS | 1281 | 1605 |
| AD09938 | AM14176-AS | 1059 | 1448 | AM13897-SS | 1279 | 1603 |
| AD09962 | AM14204-AS | 1060 | 1451 | AM14203-SS | 1282 | 1606 |
| AD09963 | AM14206-AS | 1061 | 1452 | AM14205-SS | 1283 | 1607 |
| AD09964 | AM14208-AS | 1062 | 1453 | AM14207-SS | 1284 | 1608 |
| AD09965 | AM14209-AS | 1063 | 1450 | AM14174-SS | 1281 | 1605 |
| AD09966 | AM14210-AS | 1064 | 1450 | AM14174-SS | 1281 | 1605 |
| AD09967 | AM14211-AS | 1065 | 1450 | AM14174-SS | 1281 | 1605 |
| AD09968 | AM14212-AS | 1066 | 1450 | AM14174-SS | 1281 | 1605 |
| AD09969 | AM14211-AS | 1065 | 1450 | AM14213-SS | 1285 | 1605 |

TABLE 5A-continued

XDH RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD09970 | AM14211-AS | 1065 | 1450 | AM14214-SS | 1286 | 1605 |
| AD09971 | AM14216-AS | 1067 | 1454 | AM14215-SS | 1287 | 1609 |
| AD09972 | AM14218-AS | 1068 | 1455 | AM14217-SS | 1288 | 1610 |
| AD09973 | AM14220-AS | 1069 | 1456 | AM14219-SS | 1289 | 1611 |
| AD09974 | AM14222-AS | 1070 | 1457 | AM14221-SS | 1290 | 1612 |
| AD09975 | AM14224-AS | 1071 | 1458 | AM14223-SS | 1291 | 1613 |
| AD09976 | AM14226-AS | 1072 | 1459 | AM14225-SS | 1292 | 1614 |
| AD09977 | AM14228-AS | 1073 | 1460 | AM14227-SS | 1293 | 1615 |
| AD09978 | AM14230-AS | 1074 | 1461 | AM14229-SS | 1294 | 1616 |
| AD09979 | AM14232-AS | 1075 | 1462 | AM14231-SS | 1295 | 1617 |
| AD09980 | AM14234-AS | 1076 | 1463 | AM14233-SS | 1296 | 1618 |
| AD09981 | AM14236-AS | 1077 | 1464 | AM14235-SS | 1297 | 1619 |
| AD09982 | AM14238-AS | 1078 | 1465 | AM14237-SS | 1298 | 1620 |
| AD09983 | AM14240-AS | 1079 | 1466 | AM14239-SS | 1299 | 1621 |
| AD09984 | AM14242-AS | 1080 | 1467 | AM14241-SS | 1300 | 1622 |
| AD09985 | AM14244-AS | 1081 | 1468 | AM14243-SS | 1301 | 1623 |
| AD09986 | AM14246-AS | 1082 | 1469 | AM14245-SS | 1302 | 1624 |
| AD09987 | AM14248-AS | 1083 | 1470 | AM14247-SS | 1303 | 1625 |
| AD09988 | AM14250-AS | 1084 | 1471 | AM14249-SS | 1304 | 1626 |
| AD09989 | AM14252-AS | 1085 | 1472 | AM14251-SS | 1305 | 1627 |
| AD09990 | AM14254-AS | 1086 | 1473 | AM14253-SS | 1306 | 1628 |
| AD09991 | AM14256-AS | 1087 | 1474 | AM14255-SS | 1307 | 1629 |
| AD09992 | AM14258-AS | 1088 | 1475 | AM14257-SS | 1308 | 1630 |
| AD09993 | AM14260-AS | 1089 | 1476 | AM14259-SS | 1309 | 1631 |
| AD09994 | AM14262-AS | 1090 | 1477 | AM14261-SS | 1310 | 1632 |
| AD09995 | AM14264-AS | 1091 | 1478 | AM14263-SS | 1311 | 1633 |
| AD10008 | AM14280-AS | 1092 | 1448 | AM13897-SS | 1279 | 1603 |
| AD10009 | AM14281-AS | 1093 | 1448 | AM13897-SS | 1279 | 1603 |
| AD10010 | AM14282-AS | 1094 | 1448 | AM13897-SS | 1279 | 1603 |
| AD10011 | AM14283-AS | 1095 | 1448 | AM13897-SS | 1279 | 1603 |
| AD10012 | AM14282-AS | 1094 | 1448 | AM14284-SS | 1312 | 1603 |
| AD10013 | AM14285-AS | 1096 | 1448 | AM14284-SS | 1312 | 1603 |
| AD10014 | AM14282-AS | 1094 | 1448 | AM14286-SS | 1313 | 1603 |
| AD10015 | AM14285-AS | 1096 | 1448 | AM14286-SS | 1313 | 1603 |
| AD10016 | AM14288-AS | 1097 | 1479 | AM14287-SS | 1314 | 1634 |
| AD10017 | AM14290-AS | 1098 | 1480 | AM14289-SS | 1315 | 1635 |
| AD10018 | AM14292-AS | 1099 | 1481 | AM14291-SS | 1316 | 1636 |
| AD10019 | AM14293-AS | 1100 | 1482 | AM14291-SS | 1316 | 1636 |
| AD10020 | AM14292-AS | 1099 | 1481 | AM14294-SS | 1317 | 1637 |
| AD10021 | AM14296-AS | 1101 | 1482 | AM14295-SS | 1318 | 1638 |
| AD10022 | AM14297-AS | 1102 | 1482 | AM14295-SS | 1318 | 1638 |
| AD10023 | AM14298-AS | 1103 | 1482 | AM14295-SS | 1318 | 1638 |
| AD10024 | AM14299-AS | 1104 | 1482 | AM14295-SS | 1318 | 1638 |
| AD10025 | AM14299-AS | 1104 | 1482 | AM14300-SS | 1319 | 1639 |
| AD10026 | AM14301-AS | 1105 | 1482 | AM14295-SS | 1318 | 1638 |
| AD10027 | AM14299-AS | 1104 | 1482 | AM14302-SS | 1320 | 1638 |
| AD10028 | AM14299-AS | 1104 | 1482 | AM14303-SS | 1321 | 1638 |
| AD10029 | AM14304-AS | 1106 | 1482 | AM14303-SS | 1321 | 1638 |
| AD10030 | AM14305-AS | 1107 | 1482 | AM14302-SS | 1320 | 1638 |
| AD10091 | AM14383-AS | 1108 | 1438 | AM13877-SS | 1269 | 1593 |
| AD10092 | AM14384-AS | 1109 | 1438 | AM13877-SS | 1269 | 1593 |
| AD10093 | AM14385-AS | 1110 | 1438 | AM13877-SS | 1269 | 1593 |
| AD10094 | AM14384-AS | 1109 | 1438 | AM14386-SS | 1322 | 1593 |
| AD10095 | AM14385-AS | 1110 | 1438 | AM14386-SS | 1322 | 1593 |
| AD10096 | AM14387-AS | 1111 | 1438 | AM13877-SS | 1269 | 1593 |
| AD10097 | AM14388-AS | 1112 | 1438 | AM13877-SS | 1269 | 1593 |
| AD10099 | AM14391-AS | 1113 | 1483 | AM14390-SS | 1323 | 1640 |
| AD10100 | AM14393-AS | 1114 | 1484 | AM14392-SS | 1324 | 1641 |
| AD10101 | AM14395-AS | 1115 | 1485 | AM14394-SS | 1325 | 1642 |
| AD10102 | AM14397-AS | 1116 | 1486 | AM14396-SS | 1326 | 1643 |
| AD10103 | AM14399-AS | 1117 | 1487 | AM14398-SS | 1327 | 1644 |
| AD10104 | AM14401-AS | 1118 | 1488 | AM14400-SS | 1328 | 1645 |
| AD10105 | AM14403-AS | 1119 | 1489 | AM14402-SS | 1329 | 1646 |
| AD10106 | AM14405-AS | 1120 | 1490 | AM14404-SS | 1330 | 1647 |
| AD10107 | AM14407-AS | 1121 | 1491 | AM14406-SS | 1331 | 1648 |
| AD10108 | AM14409-AS | 1122 | 1492 | AM14408-SS | 1332 | 1649 |
| AD10109 | AM14411-AS | 1123 | 1493 | AM14410-SS | 1333 | 1650 |
| AD10110 | AM14413-AS | 1124 | 1494 | AM14412-SS | 1334 | 1651 |
| AD10111 | AM14415-AS | 1125 | 1495 | AM14414-SS | 1335 | 1652 |
| AD10112 | AM14417-AS | 1126 | 1496 | AM14416-SS | 1336 | 1653 |
| AD10113 | AM14419-AS | 1127 | 1497 | AM14418-SS | 1337 | 1654 |
| AD10176 | AM14522-AS | 1128 | 1377 | AM13169-SS | 1201 | 1531 |

TABLE 5A-continued

XDH RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD10177 | AM14523-AS | 1129 | 1377 | AM13169-SS | 1201 | 1531 |
| AD10178 | AM14524-AS | 1130 | 1377 | AM13169-SS | 1201 | 1531 |
| AD10179 | AM14524-AS | 1130 | 1377 | AM14525-SS | 1338 | 1531 |
| AD10180 | AM14524-AS | 1130 | 1377 | AM14526-SS | 1339 | 1531 |
| AD10181 | AM14527-AS | 1131 | 1397 | AM13673-SS | 1223 | 1551 |
| AD10182 | AM14529-AS | 1132 | 1397 | AM14528-SS | 1340 | 1551 |
| AD10183 | AM14530-AS | 1133 | 1397 | AM14528-SS | 1340 | 1551 |
| AD10184 | AM14529-AS | 1132 | 1397 | AM14531-SS | 1341 | 1551 |
| AD10200 | AM14543-AS | 1134 | 1397 | AM13673-SS | 1223 | 1551 |
| AD10201 | AM14544-AS | 1135 | 1397 | AM13673-SS | 1223 | 1551 |
| AD10202 | AM14545-AS | 1136 | 1397 | AM13673-SS | 1223 | 1551 |
| AD10203 | AM14544-AS | 1135 | 1397 | AM14528-SS | 1340 | 1551 |
| AD10204 | AM14545-AS | 1136 | 1397 | AM14528-SS | 1340 | 1551 |
| AD10205 | AM14544-AS | 1135 | 1397 | AM14531-SS | 1341 | 1551 |
| AD10275 | AM14642-AS | 1137 | 1440 | AM13881-SS | 1271 | 1595 |
| AD10276 | AM14643-AS | 1138 | 1440 | AM13881-SS | 1271 | 1595 |
| AD10277 | AM14644-AS | 1139 | 1440 | AM13881-SS | 1271 | 1595 |
| AD10278 | AM14645-AS | 1140 | 1440 | AM13881-SS | 1271 | 1595 |
| AD10279 | AM14644-AS | 1139 | 1440 | AM14646-SS | 1342 | 1595 |
| AD10280 | AM14647-AS | 1141 | 1440 | AM14646-SS | 1342 | 1595 |
| AD10281 | AM14648-AS | 1142 | 1440 | AM14646-SS | 1342 | 1595 |
| AD10282 | AM14649-AS | 1143 | 1440 | AM14646-SS | 1342 | 1595 |
| AD10283 | AM14650-AS | 1144 | 1440 | AM14646-SS | 1342 | 1595 |
| AD10619 | AM14281-AS | 1093 | 1448 | AM14284-SS | 1312 | 1603 |
| AD10620 | AM15134-AS | 1145 | 1448 | AM14284-SS | 1312 | 1603 |
| AD10621 | AM15135-AS | 1146 | 1448 | AM14284-SS | 1312 | 1603 |
| AD10622 | AM14283-AS | 1095 | 1448 | AM14284-SS | 1312 | 1603 |
| AD10623 | AM15137-AS | 1147 | 1498 | AM15136-SS | 1343 | 1655 |
| AD10624 | AM15139-AS | 1148 | 1499 | AM15138-SS | 1344 | 1656 |
| AD10625 | AM15141-AS | 1149 | 1500 | AM15140-SS | 1345 | 1657 |
| AD10626 | AM15143-AS | 1150 | 1501 | AM15142-SS | 1346 | 1658 |
| AD10627 | AM15145-AS | 1151 | 1502 | AM15144-SS | 1347 | 1659 |
| AD10628 | AM15146-AS | 1152 | 1448 | AM14284-SS | 1312 | 1603 |
| AD10629 | AM15147-AS | 1153 | 1397 | AM14528-SS | 1340 | 1551 |
| AD10630 | AM15148-AS | 1154 | 1397 | AM14528-SS | 1340 | 1551 |
| AD10631 | AM15149-AS | 1155 | 1397 | AM14528-SS | 1340 | 1551 |
| AD10632 | AM15150-AS | 1156 | 1397 | AM14528-SS | 1340 | 1551 |
| AD10633 | AM15151-AS | 1157 | 1397 | AM14531-SS | 1341 | 1551 |
| AD10634 | AM15152-AS | 1158 | 1397 | AM14531-SS | 1341 | 1551 |
| AD10635 | AM15153-AS | 1159 | 1397 | AM14531-SS | 1341 | 1551 |
| AD10636 | AM15154-AS | 1160 | 1397 | AM14531-SS | 1341 | 1551 |
| AD10728 | AM14244-AS | 1081 | 1468 | AM15284-SS | 1348 | 1623 |
| AD10729 | AM15285-AS | 1161 | 1468 | AM15284-SS | 1348 | 1623 |
| AD10730 | AM15286-AS | 1162 | 1468 | AM15284-SS | 1348 | 1623 |
| AD10731 | AM15287-AS | 1163 | 1468 | AM15284-SS | 1348 | 1623 |
| AD10732 | AM15289-AS | 1164 | 1503 | AM15288-SS | 1349 | 1660 |
| AD10733 | AM15290-AS | 1165 | 1468 | AM15284-SS | 1348 | 1623 |
| AD10734 | AM15291-AS | 1166 | 1468 | AM15284-SS | 1348 | 1623 |
| AD10735 | AM15292-AS | 1167 | 1468 | AM15284-SS | 1348 | 1623 |
| AD10736 | AM15294-AS | 1168 | 1504 | AM15293-SS | 1350 | 1661 |
| AD10737 | AM15296-AS | 1169 | 1505 | AM15295-SS | 1351 | 1662 |
| AD10952 | AM15606-AS | 1170 | 1448 | AM14284-SS | 1312 | 1603 |
| AD10953 | AM15607-AS | 1171 | 1498 | AM15136-SS | 1343 | 1655 |
| AD10954 | AM15608-AS | 1172 | 1450 | AM14213-SS | 1285 | 1605 |
| AD10967 | AM13882-AS | 1048 | 1440 | AM14646-SS | 1342 | 1595 |
| AD10968 | AM15626-AS | 1173 | 1440 | AM14646-SS | 1342 | 1595 |
| AD10969 | AM15627-AS | 1174 | 1440 | AM14646-SS | 1342 | 1595 |
| AD12167 | AM17243-AS | 1672 | 1674 | AM17242-SS | 1676 | 1678 |
| AD12168 | AM17245-AS | 1673 | 1675 | AM17244-SS | 1677 | 1679 |

TABLE 5B

XDH RNAi Agents Duplexes with Corresponding Sense and Antisense Strand ID Numbers Referencing Position Targeted on XDH Gene (SEQ ID NO: 1)

| Duplex ID | Antisense Strand ID | Sense Strand ID | Targeted XDH Gene Position (Of SEQ ID NO: 1) |
|---|---|---|---|
| AD09217 | AM13029-AS | AM13028-SS | 488 |
| AD09218 | AM13031-AS | AM13030-SS | 488 |
| AD09219 | AM13033-AS | AM13032-SS | 1612 |
| AD09220 | AM13035-AS | AM13034-SS | 1614 |
| AD09221 | AM13037-AS | AM13036-SS | 1617 |
| AD09222 | AM13039-AS | AM13038-SS | 2128 |
| AD09223 | AM13041-AS | AM13040-SS | 2130 |
| AD09224 | AM13043-AS | AM13042-SS | 2131 |
| AD09225 | AM13045-AS | AM13044-SS | 2132 |
| AD09226 | AM13047-AS | AM13046-SS | 2153 |
| AD09227 | AM13049-AS | AM13048-SS | 2185 |
| AD09228 | AM13051-AS | AM13050-SS | 2186 |
| AD09229 | AM13053-AS | AM13052-SS | 3272 |
| AD09230 | AM13055-AS | AM13054-SS | 435 |
| AD09231 | AM13057-AS | AM13056-SS | 2571 |
| AD09232 | AM13059-AS | AM13058-SS | 2612 |
| AD09233 | AM13061-AS | AM13060-SS | 2616 |
| AD09234 | AM13063-AS | AM13062-SS | 2617 |
| AD09235 | AM13065-AS | AM13064-SS | 2619 |
| AD09236 | AM13067-AS | AM13066-SS | 3045 |
| AD09237 | AM13069-AS | AM13068-SS | 3548 |
| AD09238 | AM13071-AS | AM13070-SS | 3551 |
| AD09239 | AM13073-AS | AM13072-SS | 3640 |
| AD09302 | AM13164-AS | AM13163-SS | 265 |
| AD09303 | AM13166-AS | AM13165-SS | 2248 |
| AD09304 | AM13168-AS | AM13167-SS | 2694 |
| AD09305 | AM13170-AS | AM13169-SS | 3083 |
| AD09306 | AM13172-AS | AM13171-SS | 4665 |
| AD09307 | AM13174-AS | AM13173-SS | 4725 |
| AD09308 | AM13176-AS | AM13175-SS | 265 |
| AD09309 | AM13177-AS | AM13165-SS | 2248 |
| AD09310 | AM13179-AS | AM13178-SS | 2694 |
| AD09311 | AM13181-AS | AM13180-SS | 4725 |
| AD09323 | AM13204-AS | AM13163-SS | 265 |
| AD09324 | AM13205-AS | AM13167-SS | 2694 |
| AD09325 | AM13206-AS | AM13169-SS | 3083 |
| AD09326 | AM13207-AS | AM13171-SS | 4665 |
| AD09571 | AM13600-AS | AM13599-SS | 2850 |
| AD09572 | AM13602-AS | AM13601-SS | 2851 |
| AD09573 | AM13604-AS | AM13603-SS | 2852 |
| AD09598 | AM13648-AS | AM13647-SS | 235 |
| AD09599 | AM13650-AS | AM13649-SS | 249 |
| AD09600 | AM13652-AS | AM13651-SS | 252 |
| AD09601 | AM13654-AS | AM13653-SS | 1703 |
| AD09602 | AM13656-AS | AM13655-SS | 2049 |
| AD09603 | AM13658-AS | AM13657-SS | 2155 |
| AD09604 | AM13660-AS | AM13659-SS | 2997 |
| AD09605 | AM13662-AS | AM13661-SS | 3019 |
| AD09606 | AM13664-AS | AM13663-SS | 3020 |
| AD09607 | AM13666-AS | AM13665-SS | 3037 |
| AD09608 | AM13668-AS | AM13667-SS | 4136 |
| AD09609 | AM13670-AS | AM13669-SS | 4149 |
| AD09610 | AM13672-AS | AM13671-SS | 4150 |
| AD09611 | AM13674-AS | AM13673-SS | 4289 |
| AD09612 | AM13676-AS | AM13675-SS | 4446 |
| AD09613 | AM13678-AS | AM13677-SS | 4505 |
| AD09614 | AM13680-AS | AM13679-SS | 4515 |
| AD09615 | AM13682-AS | AM13681-SS | 4517 |
| AD09616 | AM13684-AS | AM13683-SS | 4518 |
| AD09617 | AM13686-AS | AM13685-SS | 4520 |
| AD09618 | AM13688-AS | AM13687-SS | 4525 |
| AD09619 | AM13690-AS | AM13689-SS | 4700 |
| AD09620 | AM13692-AS | AM13691-SS | 5286 |
| AD09621 | AM13694-AS | AM13693-SS | 5420 |
| AD09623 | AM13696-AS | AM13695-SS | N/A (mouse-specific RNAi agent) |
| AD09624 | AM13698-AS | AM13697-SS | N/A (mouse-specific RNAi agent) |
| AD09625 | AM13700-AS | AM13699-SS | N/A (mouse-specific RNAi agent) |
| AD09626 | AM13702-AS | AM13701-SS | N/A (mouse-specific RNAi agent) |

TABLE 5B-continued

XDH RNAi Agents Duplexes with Corresponding Sense and Antisense Strand ID Numbers Referencing Position Targeted on XDH Gene (SEQ ID NO: 1)

| Duplex ID | Antisense Strand ID | Sense Strand ID | Targeted XDH Gene Position (Of SEQ ID NO: 1) |
|---|---|---|---|
| AD09627 | AM13704-AS | AM13703-SS | N/A (mouse-specific RNAi agent) |
| AD09628 | AM13706-AS | AM13705-SS | N/A (mouse-specific RNAi agent) |
| AD09629 | AM13708-AS | AM13707-SS | N/A (mouse-specific RNAi agent) |
| AD09630 | AM13710-AS | AM13709-SS | N/A (mouse-specific RNAi agent) |
| AD09631 | AM13712-AS | AM13711-SS | N/A (mouse-specific RNAi agent) |
| AD09632 | AM13714-AS | AM13713-SS | N/A (mouse-specific RNAi agent) |
| AD09633 | AM13716-AS | AM13715-SS | N/A (mouse-specific RNAi agent) |
| AD09634 | AM13718-AS | AM13717-SS | N/A (mouse-specific RNAi agent) |
| AD09635 | AM13720-AS | AM13719-SS | N/A (mouse-specific RNAi agent) |
| AD09636 | AM13722-AS | AM13721-SS | N/A (mouse-specific RNAi agent) |
| AD09637 | AM13724-AS | AM13723-SS | N/A (mouse-specific RNAi agent) |
| AD09638 | AM13726-AS | AM13725-SS | N/A (mouse-specific RNAi agent) |
| AD09639 | AM13728-AS | AM13727-SS | N/A (mouse-specific RNAi agent) |
| AD09640 | AM13730-AS | AM13729-SS | N/A (mouse-specific RNAi agent) |
| AD09650 | AM13747-AS | AM13746-SS | 2612 |
| AD09651 | AM13748-AS | AM13746-SS | 2612 |
| AD09652 | AM13749-AS | AM13746-SS | 2612 |
| AD09653 | AM13748-AS | AM13750-SS | 2612 |
| AD09654 | AM13748-AS | AM13751-SS | 2612 |
| AD09655 | AM13748-AS | AM13752-SS | 2612 |
| AD09656 | AM13753-AS | AM13746-SS | 2612 |
| AD09657 | AM13754-AS | AM13746-SS | 2612 |
| AD09658 | AM13755-AS | AM13746-SS | 2612 |
| AD09659 | AM13748-AS | AM13058-SS | 2612 |
| AD09660 | AM13748-AS | AM13756-SS | 2612 |
| AD09661 | AM13748-AS | AM13757-SS | 2612 |
| AD09662 | AM13758-AS | AM13060-SS | 2616 |
| AD09663 | AM13759-AS | AM13060-SS | 2616 |
| AD09664 | AM13758-AS | AM13760-SS | 2616 |
| AD09665 | AM13761-AS | AM13760-SS | 2616 |
| AD09724 | AM13858-AS | AM13857-SS | 122 |
| AD09725 | AM13860-AS | AM13859-SS | 139 |
| AD09726 | AM13862-AS | AM13861-SS | 239 |
| AD09727 | AM13864-AS | AM13863-SS | 332 |
| AD09728 | AM13866-AS | AM13865-SS | 430 |
| AD09729 | AM13868-AS | AM13867-SS | 500 |
| AD09730 | AM13870-AS | AM13869-SS | 867 |
| AD09731 | AM13872-AS | AM13871-SS | 877 |
| AD09732 | AM13874-AS | AM13873-SS | 888 |
| AD09733 | AM13876-AS | AM13875-SS | 1285 |
| AD09734 | AM13878-AS | AM13877-SS | 1322 |
| AD09735 | AM13880-AS | AM13879-SS | 1921 |
| AD09736 | AM13882-AS | AM13881-SS | 1963 |
| AD09737 | AM13884-AS | AM13883-SS | 2138 |
| AD09738 | AM13886-AS | AM13885-SS | 2148 |
| AD09739 | AM13888-AS | AM13887-SS | 2157 |
| AD09740 | AM13890-AS | AM13889-SS | 2209 |
| AD09741 | AM13892-AS | AM13891-SS | 2320 |
| AD09742 | AM13894-AS | AM13893-SS | 2357 |
| AD09743 | AM13896-AS | AM13895-SS | 2361 |
| AD09744 | AM13898-AS | AM13897-SS | 2696 |
| AD09745 | AM13900-AS | AM13899-SS | 2701 |
| AD09937 | AM14175-AS | AM14174-SS | 1963 |
| AD09938 | AM14176-AS | AM13897-SS | 2696 |
| AD09962 | AM14204-AS | AM14203-SS | 1964 |
| AD09963 | AM14206-AS | AM14205-SS | 1965 |
| AD09964 | AM14208-AS | AM14207-SS | 1967 |
| AD09965 | AM14209-AS | AM14174-SS | 1963 |

TABLE 5B-continued

XDH RNAi Agents Duplexes with Corresponding Sense and Antisense Strand ID Numbers Referencing Position Targeted on XDH Gene (SEQ ID NO: 1)

| Duplex ID | Antisense Strand ID | Sense Strand ID | Targeted XDH Gene Position (Of SEQ ID NO: 1) |
|---|---|---|---|
| AD09966 | AM14210-AS | AM14174-SS | 1963 |
| AD09967 | AM14211-AS | AM14174-SS | 1963 |
| AD09968 | AM14212-AS | AM14174-SS | 1963 |
| AD09969 | AM14211-AS | AM14213-SS | 1963 |
| AD09970 | AM14211-AS | AM14214-SS | 1963 |
| AD09971 | AM14216-AS | AM14215-SS | 238 |
| AD09972 | AM14218-AS | AM14217-SS | 484 |
| AD09973 | AM14220-AS | AM14219-SS | 493 |
| AD09974 | AM14222-AS | AM14221-SS | 497 |
| AD09975 | AM14224-AS | AM14223-SS | 886 |
| AD09976 | AM14226-AS | AM14225-SS | 1117 |
| AD09977 | AM14228-AS | AM14227-SS | 1615 |
| AD09978 | AM14230-AS | AM14229-SS | 2064 |
| AD09979 | AM14232-AS | AM14231-SS | 2370 |
| AD09980 | AM14234-AS | AM14233-SS | 2684 |
| AD09981 | AM14236-AS | AM14235-SS | 2995 |
| AD09982 | AM14238-AS | AM14237-SS | 3016 |
| AD09983 | AM14240-AS | AM14239-SS | 3041 |
| AD09984 | AM14242-AS | AM14241-SS | 3498 |
| AD09985 | AM14244-AS | AM14243-SS | 3598 |
| AD09986 | AM14246-AS | AM14245-SS | 3600 |
| AD09987 | AM14248-AS | AM14247-SS | 3877 |
| AD09988 | AM14250-AS | AM14249-SS | 3930 |
| AD09989 | AM14252-AS | AM14251-SS | 4394 |
| AD09990 | AM14254-AS | AM14253-SS | 4513 |
| AD09991 | AM14256-AS | AM14255-SS | 4531 |
| AD09992 | AM14258-AS | AM14257-SS | 4666 |
| AD09993 | AM14260-AS | AM14259-SS | 4843 |
| AD09994 | AM14262-AS | AM14261-SS | 5234 |
| AD09995 | AM14264-AS | AM14263-SS | 5411 |
| AD10008 | AM14280-AS | AM13897-SS | 2696 |
| AD10009 | AM14281-AS | AM13897-SS | 2696 |
| AD10010 | AM14282-AS | AM13897-SS | 2696 |
| AD10011 | AM14283-AS | AM13897-SS | 2696 |
| AD10012 | AM14282-AS | AM14284-SS | 2696 |
| AD10013 | AM14285-AS | AM14284-SS | 2696 |
| AD10014 | AM14282-AS | AM14286-SS | 2696 |
| AD10015 | AM14285-AS | AM14286-SS | 2696 |
| AD10016 | AM14288-AS | AM14287-SS | 231 |
| AD10017 | AM14290-AS | AM14289-SS | 242 |
| AD10018 | AM14292-AS | AM14291-SS | 1384 |
| AD10019 | AM14293-AS | AM14291-SS | 1384 |
| AD10020 | AM14292-AS | AM14294-SS | 1384 |
| AD10021 | AM14296-AS | AM14295-SS | 1612 |
| AD10022 | AM14297-AS | AM14295-SS | 1612 |
| AD10023 | AM14298-AS | AM14295-SS | 1612 |
| AD10024 | AM14299-AS | AM14295-SS | 1612 |
| AD10025 | AM14299-AS | AM14300-SS | 1612 |
| AD10026 | AM14301-AS | AM14295-SS | 1612 |
| AD10027 | AM14299-AS | AM14302-SS | 1612 |
| AD10028 | AM14299-AS | AM14303-SS | 1612 |
| AD10029 | AM14304-AS | AM14303-SS | 1612 |
| AD10030 | AM14305-AS | AM14302-SS | 1612 |
| AD10091 | AM14383-AS | AM13877-SS | 1322 |
| AD10092 | AM14384-AS | AM13877-SS | 1322 |
| AD10093 | AM14385-AS | AM13877-SS | 1322 |
| AD10094 | AM14384-AS | AM14386-SS | 1322 |
| AD10095 | AM14385-AS | AM14386-SS | 1322 |
| AD10096 | AM14387-AS | AM13877-SS | 1322 |
| AD10097 | AM14388-AS | AM13877-SS | 1322 |
| AD10099 | AM14391-AS | AM14390-SS | 263 |
| AD10100 | AM14393-AS | AM14392-SS | 318 |
| AD10101 | AM14395-AS | AM14394-SS | 328 |
| AD10102 | AM14397-AS | AM14396-SS | 482 |
| AD10103 | AM14399-AS | AM14398-SS | 857 |
| AD10104 | AM14401-AS | AM14400-SS | 874 |
| AD10105 | AM14403-AS | AM14402-SS | 1278 |
| AD10106 | AM14405-AS | AM14404-SS | 1319 |
| AD10107 | AM14407-AS | AM14406-SS | 1320 |
| AD10108 | AM14409-AS | AM14408-SS | 1351 |
| AD10109 | AM14411-AS | AM14410-SS | 2006 |
| AD10110 | AM14413-AS | AM14412-SS | 2156 |

TABLE 5B-continued

XDH RNAi Agents Duplexes with Corresponding Sense and Antisense Strand ID Numbers Referencing Position Targeted on XDH Gene (SEQ ID NO: 1)

| Duplex ID | Antisense Strand ID | Sense Strand ID | Targeted XDH Gene Position (Of SEQ ID NO: 1) |
|---|---|---|---|
| AD10111 | AM14415-AS | AM14414-SS | 2398 |
| AD10112 | AM14417-AS | AM14416-SS | 2400 |
| AD10113 | AM14419-AS | AM14418-SS | 2435 |
| AD10176 | AM14522-AS | AM13169-SS | 3083 |
| AD10177 | AM14523-AS | AM13169-SS | 3083 |
| AD10178 | AM14524-AS | AM13169-SS | 3083 |
| AD10179 | AM14524-AS | AM14525-SS | 3083 |
| AD10180 | AM14524-AS | AM14526-SS | 3083 |
| AD10181 | AM14527-AS | AM13673-SS | 4289 |
| AD10182 | AM14529-AS | AM14528-SS | 4289 |
| AD10183 | AM14530-AS | AM14528-SS | 4289 |
| AD10184 | AM14529-AS | AM14531-SS | 4289 |
| AD10200 | AM14543-AS | AM13673-SS | 4289 |
| AD10201 | AM14544-AS | AM13673-SS | 4289 |
| AD10202 | AM14545-AS | AM13673-SS | 4289 |
| AD10203 | AM14544-AS | AM14528-SS | 4289 |
| AD10204 | AM14545-AS | AM14528-SS | 4289 |
| AD10205 | AM14544-AS | AM14531-SS | 4289 |
| AD10275 | AM14642-AS | AM13881-SS | 1963 |
| AD10276 | AM14643-AS | AM13881-SS | 1963 |
| AD10277 | AM14644-AS | AM13881-SS | 1963 |
| AD10278 | AM14645-AS | AM13881-SS | 1963 |
| AD10279 | AM14644-AS | AM14646-SS | 1963 |
| AD10280 | AM14647-AS | AM14646-SS | 1963 |
| AD10281 | AM14648-AS | AM14646-SS | 1963 |
| AD10282 | AM14649-AS | AM14646-SS | 1963 |
| AD10283 | AM14650-AS | AM14646-SS | 1963 |
| AD10619 | AM14281-AS | AM14284-SS | 2696 |
| AD10620 | AM15134-AS | AM14284-SS | 2696 |
| AD10621 | AM15135-AS | AM14284-SS | 2696 |
| AD10622 | AM14283-AS | AM14284-SS | 2696 |
| AD10623 | AM15137-AS | AM15136-SS | 2696 |
| AD10624 | AM15139-AS | AM15138-SS | 2696 |
| AD10625 | AM15141-AS | AM15140-SS | 2696 |
| AD10626 | AM15143-AS | AM15142-SS | 2696 |
| AD10627 | AM15145-AS | AM15144-SS | 2696 |
| AD10628 | AM15146-AS | AM14284-SS | 2696 |
| AD10629 | AM15147-AS | AM14528-SS | 4289 |
| AD10630 | AM15148-AS | AM14528-SS | 4289 |
| AD10631 | AM15149-AS | AM14528-SS | 4289 |
| AD10632 | AM15150-AS | AM14528-SS | 4289 |
| AD10633 | AM15151-AS | AM14531-SS | 4289 |
| AD10634 | AM15152-AS | AM14531-SS | 4289 |
| AD10635 | AM15153-AS | AM14531-SS | 4289 |
| AD10636 | AM15154-AS | AM14531-SS | 4289 |
| AD10728 | AM14244-AS | AM15284-SS | 3598 |
| AD10729 | AM15285-AS | AM15284-SS | 3598 |
| AD10730 | AM15286-AS | AM15284-SS | 3598 |
| AD10731 | AM15287-AS | AM15284-SS | 3598 |
| AD10732 | AM15289-AS | AM15288-SS | 3598 |
| AD10733 | AM15290-AS | AM15284-SS | 3598 |
| AD10734 | AM15291-AS | AM15284-SS | 3598 |
| AD10735 | AM15292-AS | AM15284-SS | 3598 |
| AD10736 | AM15294-AS | AM15293-SS | 3598 |
| AD10737 | AM15296-AS | AM15295-SS | 3598 |
| AD10952 | AM15606-AS | AM14284-SS | 2696 |
| AD10953 | AM15607-AS | AM15136-SS | 2696 |
| AD10954 | AM15608-AS | AM14213-SS | 1963 |
| AD10967 | AM13882-AS | AM14646-SS | 1963 |
| AD10968 | AM15626-AS | AM14646-SS | 1963 |
| AD10969 | AM15627-AS | AM14646-SS | 1963 |
| AD12167 | AM17243-AS | AM17242-SS | 2701 |
| AD12168 | AM17245-AS | AM17244-SS | 2696 |

TABLE 5C

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD09217 | usUfsgsGfaAfgGfcAfuUfcUfcAfaUfcUfsc | 945 | (NAG37)s(invAb)sgagauugaGfAfAfugccuuccaas(invAb) | 1175 |
| AD09218 | usUfsggaAfgGfCfauucUfcAfaucusc | 946 | (NAG37)s(invAb)sgagauuGfaGfAfAfugccuuccaas(invAb) | 1176 |
| AD09219 | asAfscsUfuGfaAfgAfaGfaAfgCfuGfaGfsg | 947 | (NAG37)s(invAb)sccucagcuUfCfUfucuucaaguus(invAb) | 1177 |
| AD09220 | asGfsasAfcUfuGfaAfgAfaGfaAfgCfuGfsc | 948 | (NAG37)s(invAb)sgcagcuucUfUfCfuucaaguucus(invAb) | 1178 |
| AD09221 | usGfsusAfgAfaCfuUfgAfaGfaAfgAfaGfsc | 949 | (NAG37)s(invAb)sgcuucuucUfUfCfaaguucuacas(invAb) | 1179 |
| AD09222 | usCfsasUfaGfgUfgAfuUfuUfcAfcCfcCfsu | 950 | (NAG37)s(invAb)sagggugaAfAfAfucaccuaugas(invAb) | 1180 |
| AD09223 | usUfsusCfaUfaGfgUfgAfuUfuUfcAfcCfsc | 951 | (NAG37)s(invAb)sgggugaaaAfUfCfaccuaugaaas(invAb) | 1181 |
| AD09224 | usCfsusUfcAfuAfgGfuGfaUfuUfuCfaCfsc | 952 | (NAG37)s(invAb)sggugaaaaUfCfAfccuaugaagas(invAb) | 1182 |
| AD09225 | usUfscsUfuCfaUfaGfgUfgAfuUfuUfcAfsc | 953 | (NAG37)s(invAb)sgugaaaauCfAfCfcuaugaagaas(invAb) | 1183 |
| AD09226 | asAfsusUfgUfgAfuAfaUfgGfcUfgGfuAfsg | 954 | (NAG37)s(invAb)scuaccagcCfAfUfuaucacaauus(invAb) | 1184 |
| AD09227 | usCfsasUfaAfaAfgGfaGfuUfgUfuCfuUfsc | 955 | (NAG37)s(invAb)sgaagaacaAfCfUfccuuuuaugas(invAb) | 1185 |
| AD09228 | usCfscsAfuAfaAfaGfgAfgUfuGfuUfcUfsc | 956 | (NAG37)s(invAb)sgagaacaaCfUfCfcuuuuauggas(invAb) | 1186 |
| AD09229 | usAfscsAfgUfgUfuAfgUfgCfuUfgUfcUfsc | 957 | (NAG37)s(invAb)sgagacaagCfAfCfuaacacuguas(invAb) | 1187 |
| AD09230 | usUfsgsUfgUfaCfaUfaCfuCfaUfgAfcGfsa | 958 | (NAG37)s(invAb)sucgucaugAfGfUfauguacacaas(invAb) | 1188 |
| AD09231 | usAfscsCfaGfuUfaUfcAfgCfaUfgUfcCfsu | 959 | (NAG37)s(invAb)saggacaugCfUfGfauaacugiuas(invAb) | 1189 |
| AD09232 | usAfsusGfaAfgCfcAfaCfcUfuGfuAfuCfsc | 960 | (NAG37)s(invAb)sggauacaaGfGfUfuggcuucauas(invAb) | 1190 |
| AD09233 | usCfsusUfcAfuGfaAfgCfcAfaCfcUfuGfsc | 961 | (NAG37)s(invAb)sgcaagguuGfGfCfuucaugaagas(invAb) | 1191 |
| AD09234 | usUfscsUfuCfaUfgAfaGfcCfaAfcCfuUfsg | 962 | (NAG37)s(invAb)scaagguugGfCfUfucaugaagaas(invAb) | 1192 |
| AD09235 | usAfsgsUfcUfuCfaUfgAfaGfcCfaAfcCfsu | 963 | (NAG37)s(invAb)sagguuggcUfUfCfaugaagacuas(invAb) | 1193 |
| AD09236 | usCfsusUfuUfuCfcAfaCfaAfuUfcUfcCfsu | 964 | (NAG37)s(invAb)saggagaauUfGfUfuggaaaaagas(invAb) | 1194 |
| AD09237 | usUfscsUfaCfuUfcAfgAfgCfaAfgCfcAfsc | 965 | (NAG37)s(invAb)sguggcuugCfUfCfugaaguagaas(invAb) | 1195 |
| AD09238 | usAfsusUfuCfuAfcUfuCfaGfaGfcAfaGfsc | 966 | (NAG37)s(invAb)sgcuugcucUfGfAfaguagaaauas(invAb) | 1196 |
| AD09239 | usGfsusCfcAfaUfaUfcAfaUfgGfcAfgGfsg | 967 | (NAG37)s(invAb)scccugccaUfUfGfauauuigacas(invAb) | 1197 |
| AD09302 | usCfsasGfaAfaAfgUfgGfaCfgAfuCfuUfsg | 968 | (NAG37)s(invAb)scaagaucgUfCfCfacuuuucugas(invAb) | 1198 |
| AD09303 | asCfsasAfcAfuUfaUfcUfgCfuUfcGfgAfsc | 969 | (NAG37)s(invAb)sguccgaagCfAfGfauaauguugus(invAb) | 1199 |
| AD09304 | usCfsasUfaAfuAfcUfcUfgAfgAfgAfgAfsc | 970 | (NAG37)s(invAb)sgucucucuCfAfGfaguauuaugas(invAb) | 1200 |
| AD09305 | usCfsusUfaUfuCfcAfaAfcUfuGfgUfgGfsg | 971 | (NAG37)s(invAb)scccaccaaGfUfUfuggaauaagas(invAb) | 1201 |
| AD09306 | usAfsgsUfaAfuCfuUfgCfuUfuAfuGfcAfsg | 972 | (NAG37)s(invAb)scugcauaaAfGfCfaagauuacuas(invAb) | 1202 |
| AD09307 | asAfsasGfaAfaUfcUfaGfaAfcAfuUfgUfsc | 973 | (NAG37)s(invAb)sgacaauguUfCfUfagauuucuuus(invAb) | 1203 |
| AD09308 | usCfsasgaaaagugGfaCfgAfuCfuUfsg | 974 | (NAG37)s(invAb)scaagaucgUfcCfaCfuuuucugas(invAb) | 1204 |
| AD09309 | asCfsasacauUfaUfcUfgCfuUfcggasc | 975 | (NAG37)s(invAb)sguccgaagCfAfGfauaauguugus(invAb) | 1199 |
| AD09310 | usCfsasUfaAfuacucUfgAfgAfgagasc | 976 | (NAG37)s(invAb)sgucucucuCfaGfaGfuauuaugas(invAb) | 1205 |
| AD09311 | asAfsasGfaAfaUfcUfaGfaAfcAfuUfuUfsc | 977 | (NAG37)s(invAb)sgaaaauguUfCfUfagauuucuuus(invAb) | 1206 |
| AD09323 | usCfsasGfaAfaagugGfaCfgAfuCfuUfsg | 978 | (NAG37)s(invAb)scaagaucgUfCfCfacuuuucugas(invAb) | 1198 |
| AD09324 | usCfsasUfaAfuacucUfgAfgAfgAfgAfsc | 979 | (NAG37)s(invAb)sgucucucuCfAfGfaguauuaugas(invAb) | 1200 |
| AD09325 | usCfsusUfaUfuccaaAfcUfuGfgUfggsg | 980 | (NAG37)s(invAb)scccaccaaGfUfUfuggaauaagas(invAb) | 1201 |
| AD09326 | usAfsgsUfaAfucuugCfuUfuAfuGfcAfsg | 981 | (NAG37)s(invAb)scugcauaaAfGfCfaagauuacuas(invAb) | 1202 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD09571 | usAfsasCfuUfcacucAfuCfcAfgCfacsu | 982 | (NAG37)s(invAb)sagugcuggAfUfGfagugaaguuas(invAb) | 1207 |
| AD09572 | usCfsasAfcuucacuCfaUfcCfagcasc | 983 | (NAG37)s(invAb)sgugcuigaUfGfAfgugaaguugas(invAb) | 1208 |
| AD09573 | usGfscsAfacuucacUfcAfuCfcagcsa | 984 | (NAG37)s(invAb)sugcuggauGfAfGfugaaguuicas(invAb) | 1209 |
| AD09598 | usGfsasucauacuuGfgAfgAfgcausc | 985 | (NAG37)s(invAb)sgaugcucuCfcAfaGfuaugaucas(invAb) | 1210 |
| AD09599 | usCfsusuguucugcAfgAfcGfaucasc | 986 | (NAG37)s(invAb)sgugaucguCfuGfcAfgaacaagas(invAb) | 1211 |
| AD09600 | usGfsasucuuguucUfgCfaGfacgasc | 987 | (NAG37)s(invAb)sgucgucugCfaGfaAfcaagaucas(invAb) | 1212 |
| AD09601 | usAfsgsuaaaguugCfaCfuGfgcgasc | 988 | (NAG37)s(invAb)sgucgccagUfgCfaAfcuuuacuas(invAb) | 1213 |
| AD09602 | usAfsasCfacaaguaAfcCfuUfauccsu | 989 | (NAG37)s(invAb)saggauaAfgGfuUfacuuguguuas(invAb) | 1214 |
| AD09603 | usCfsasAfuugugauAfaUfgGfcuggsu | 990 | (NAG37)s(invAb)saccagccaUfuAfuCfacaauugas(invAb) | 1215 |
| AD09604 | usAfsgscaugauacUfgAfgAfgcuusg | 991 | (NAG37)s(invAb)scaagcucuCfaGfuAfucaugcuas(invAb) | 1216 |
| AD09605 | asAfscsUfugucaacCfuCfaCfucuusc | 992 | (NAG37)s(invAb)sgaagagugAfgGfuUfgacaaguus(invAb) | 1217 |
| AD09606 | usAfsasCfuugucaaCfcUfcAfcucusc | 993 | (NAG37)s(invAb)sgagagugaGfGfUfugacaaguuas(invAb) | 1218 |
| AD09607 | usAfsasCfaauucucCfuUfgUfugaasc | 994 | (NAG37)s(invAb)sguucaacaAfGfGfagaauuguuas(invAb) | 1219 |
| AD09608 | usCfsasuguucuguGfgUfaUfguucsc | 995 | (NAG37)s(invAb)sggaacaUfaCfcAfcagaacaugas(invAb) | 1220 |
| AD09609 | usAfscsUfuUfaauagAfuCfcAfuguusc | 996 | (NAG37)s(invAb)sgaacauggAfuCfuAfuuaaaguas(invAb) | 1221 |
| AD09610 | usGfsascuuuAfaUfaGfaUfcCfaugusc | 997 | (NAG37)s(invAb)sgacauggaUfcUfaUfuaaagucas(invAb) | 1222 |
| AD09611 | usGfscsauauucacCfaUfuUfaggcsa | 998 | (NAG37)s(invAb)sugccuaAfaUfgGfugaauaugcas(invAb) | 1223 |
| AD09612 | usGfsusUfuaagcuuCfuAfgAfgguusc | 999 | (NAG37)s(invAb)sgaaccucuAfGfAfagcuuaaacas(invAb) | 1224 |
| AD09613 | usUfsgsuucauuggUfuUfgAfaggcsc | 1000 | (NAG37)s(invAb)sggccuucaAfaCfcAfaugaacaas(invAb) | 1225 |
| AD09614 | usUfsasUfgCfuuugcUfgUfuCfauugsg | 1001 | (NAG37)s(invAb)sccaaugAfaCfaGfcaaagcauaas(invAb) | 1226 |
| AD09615 | usGfsusUfaugcuuuGfcUfgUfuCfausc | 1002 | (NAG37)s(invAb)sgaugaacaGfcAfAfagcauaacas(invAb) | 1227 |
| AD09616 | asGfsgsUfuaugcuuUfgCfuGfuucasc | 1003 | (NAG37)s(invAb)sgugaacagCfAfAfagcauaaccus(invAb) | 1228 |
| AD09617 | usAfsasgguuaugcUfuUfgCfuguusc | 1004 | (NAG37)s(invAb)sgaacagcaAfaGfcAfuaaccuuas(invAb) | 1229 |
| AD09618 | asGfsasUfucaagguUfaUfgCfuuugsc | 1005 | (NAG37)s(invAb)sgcaaagcaUfAfAfccuugaaucus(invAb) | 1230 |
| AD09619 | usUfscsAfauaauugAfgUfuGfguugsg | 1006 | (NAG37)s(invAb)sccaaccaaCfuCfaAfuuauugaas(invAb) | 1231 |
| AD09620 | asGfsusAfaaauggaUfcAfcAfggaasg | 1007 | (NAG37)s(invAb)scuuccuguGfAfUfccauuuuacus(invAb) | 1232 |
| AD09621 | usCfsasUfaugacagUfaAfgAfaaacsc | 1008 | (NAG37)s(invAb)sgguuuucuUfAfCfugucauaugas(invAb) | 1233 |
| AD09623 | usUfsgsgaaggcauUfcUfcGfaucusc | 1009 | (NAG37)s(invAb)sgagaucgaGfAfAfugccuuccaas(invAb) | 1234 |
| AD09624 | usCfsasUfcauugaaAfaUfgCfcagusc | 1010 | (NAG37)s(invAb)sgacuggcaUfUfUfucaaugaugas(invAb) | 1235 |
| AD09625 | asAfsasGfacaguuuCfaUfcAfuugasc | 1011 | (NAG37)s(invAb)sgucaaugaUfGfAfaacugucuuus(invAb) | 1236 |
| AD09626 | asAfscsacaaguaaCfcUfcAfuccusc | 1012 | (NAG37)s(invAb)sgaggaugaGfGfUfuacuuguguus(invAb) | 1237 |
| AD09627 | asGfsascaacauugUfcAfgCfuucasg | 1013 | (NAG37)s(invAb)scugaagcuGfAfCfaauguugucus(invAb) | 1238 |
| AD09628 | usCfsasacaucuuuGfcAfaUfaaagsc | 1014 | (NAG37)s(invAb)sgcuuuauuGfCfAfaagauguugas(invAb) | 1239 |
| AD09629 | asGfsasUfuagucuuAfcAfaAfuccusc | 1015 | (NAG37)s(invAb)sgaggauuuGfUfAfagacuaaucus(invAb) | 1240 |
| AD09630 | usCfsusUfauuccaaAfcUfuAfgucgsg | 1016 | (NAG37)s(invAb)sccgacuaaGfUfUfuggaauaagas(invAb) | 1241 |
| AD09631 | usCfsasGfaaaagaaAfgUfgUfgaagsc | 1017 | (NAG37)s(invAb)sgcuucacaCfUfUfucuuuucugas(invAb) | 1242 |
| AD09632 | usAfsgsAfguuugucUfcAfaAfgcugsc | 1018 | (NAG37)s(invAb)sgcagcuuuGfAfGfacaaacucuas(invAb) | 1243 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD09633 | usUfsgsUfuaagcagUfcAfaUfuUfcusc | 1019 | (NAG37)s(invAb)sgagaaauuGfAfCfugcuuaacaas(invAb) | 1244 |
| AD09634 | usUfsgsGfaaaucugGfaUfaCfuacgsg | 1020 | (NAG37)s(invAb)sccguaguaUfCfCfagauuuccaas(invAb) | 1245 |
| AD09635 | usCfsusUfgaaaaugCfcAfuCfcugcsu | 1021 | (NAG37)s(invAb)sagcaggauGfGfCfauuuucaagas(invAb) | 1246 |
| AD09636 | asUfsgsAfuuuggauCfaCfaAfuugusc | 1022 | (NAG37)s(invAb)sgacaauugUfGfAfuccaaaucaus(invAb) | 1247 |
| AD09637 | usAfsgsAfauuacucAfaAfaCfugccsa | 1023 | (NAG37)s(invAb)suggcaguuUfUfGfaguaauucuas(invAb) | 1248 |
| AD09638 | usGfsasucaaAfAfauGfgAfcUfcagasc | 1024 | (NAG37)s(invAb)sgucugaguCfCfAfuuuuugaucas(invAb) | 1249 |
| AD09639 | usAfsasGfaaagcauGfcAfgAfucuasg | 1025 | (NAG37)s(invAb)scuagaucuGfCfAfugcuuucuuas(invAb) | 1250 |
| AD09640 | usCfsasgauauaagCfuCfuCfugaasg | 1026 | (NAG37)s(invAb)scuucagagAfGfCfuuauaucugas(invAb) | 1251 |
| AD09650 | usAfsusGfaagccaaCfcUfuGfuAfucsc | 1027 | (NAG37)s(invAb)sggauacAfaGfgUfuggcuucauas(invAb) | 1252 |
| AD09651 | usAfsusGfaagccaaCfcUfuGfuaucsc | 1028 | (NAG37)s(invAb)sggauacAfaGfgUfuggcuucauas(invAb) | 1252 |
| AD09652 | usAfsusGfaagC$_{UNA}$caaCfcUfuGfuaucsc | 1029 | (NAG37)s(invAb)sggauacAfaGfgUfuggcuucauas(invAb) | 1252 |
| AD09653 | usAfsusGfaagccaaCfcUfuGfuaucsc | 1028 | (NAG37)s(invAb)sggauacAfaGfgUfugicuucauas(invAb) | 1253 |
| AD09654 | usAfsusGfaagccaaCfcUfuGfuaucsc | 1028 | (NAG37)s(invAb)sggauacAfaGfgUfuigcuucauas(invAb) | 1254 |
| AD09655 | usAfsusGfaagccaaCfcUfuGfuaucsc | 1028 | (NAG37)s(invAb)sggauacAfaGfgUfugguuucauas(invAb) | 1255 |
| AD09656 | usAfsusGfaagucaaCfcUfuGfuaucsc | 1030 | (NAG37)s(invAb)sggauacAfaGfgUfuggcuucauas(invAb) | 1252 |
| AD09657 | usAfsusGfaagcuaaCfcUfuGfuaucsc | 1031 | (NAG37)s(invAb)sggauacAfaGfgUfuggcuucauas(invAb) | 1252 |
| AD09658 | cPrpusAfsusGfaagccaaCfcUfuGfuaucsc | 1032 | (NAG37)s(invAb)sggauacAfaGfgUfuggcuucauas(invAb) | 1252 |
| AD09659 | usAfsusGfaagccaaCfcUfuGfuaucsc | 1028 | (NAG37)s(invAb)sggauacaaGfGfUfuggcuucauas(invAb) | 1190 |
| AD09660 | usAfsusGfaagccaaCfcUfuGfuaucsc | 1028 | (NAG37)s(invAb)sggauacaaGfgUfUfggcuucauas(invAb) | 1256 |
| AD09661 | usAfsusGfaagccaaCfcUfuGfuaucsc | 1028 | (NAG37)s(invAb)sggauacaaGfgUfuGfgcuucauas(invAb) | 1257 |
| AD09662 | usCfsusUfcaugaagCfcAfaCfcuugsc | 1028 | (NAG37)s(invAb)sgcaagguuGfGfCfuucaugaagas(invAb) | 1191 |
| AD09663 | cPrpusCfsusUfcaugaagCfcAfaCfcuugsc | 1034 | (NAG37)s(invAb)sgcaagguuGfGfCfuucaugaagas(invAb) | 1191 |
| AD09664 | usCfsusUfcaugaagCfcAfaCfcuugsc | 1033 | (NAG37)s(invAb)sgcaagguuGfgCfuUfcaugaagas(invAb) | 1258 |
| AD09665 | usCfsusUfcaU$_{UNA}$gaagCfcAfaCfcuugsc | 1035 | (NAG37)s(invAb)sgcaagguuGfgCfuUfcaugaagas(invAb) | 1258 |
| AD09724 | usGfsgsAfuCfugcauUfuUfuCfuCfcasc | 1036 | (NAG37)s(invAb)sguggagaaAfAfAfugcaiauccas(invAb) | 1259 |
| AD09725 | usCfscsAfaAfaggguUfgUfcUfcUfggsa | 1037 | (NAG37)s(invAb)succagagaCfAfAfcucuuuuggas(invAb) | 1260 |
| AD09726 | usAfsgsAfcGfaucauAfcUfuGfgAfgasg | 1038 | (NAG37)s(invAb)scucuccaaGfUfAfugauciucuas(invAb) | 1261 |
| AD09727 | usCfscsUfaUfuccuuCfcAfcAfgUfugsc | 1039 | (NAG37)s(invAb)sgcaacuguGfGfAfaggaauaggas(invAb) | 1262 |
| AD09728 | usAfscsAfuAfcucauGfaCfgAfuGfccsa | 1040 | (NAG37)s(invAb)suggcaucgUfCfAfugaguauguas(invAb) | 1263 |
| AD09729 | usCfsasCfaGfauuucCfuUfgGfaAfggsc | 1041 | (NAG37)s(invAb)sgccuuccaAfGfGfaaaucuguias(invAb) | 1264 |
| AD09730 | usGfsasAfcUfucaucUfcAfaUfgCfcasc | 1042 | (NAG37)s(invAb)sguggcauuGfAfGfaugaaguucas(invAb) | 1265 |
| AD09731 | asGfscsAfuAfuucuuGfaAfcUfuCfausc | 1043 | (NAG37)s(invAb)sga_2NugaaguUfCfAfagaauaugcus (invAb) | 1266 |
| AD09732 | usCfsasUfaGfgaaacAfgCfaUfaUfucsc | 1044 | (NAG37)s(invAb)sggaauaugCfUfGfuuuccuaugas(invAb) | 1267 |
| AD09733 | usGfsgsAfuCfucuauGfgAfgAfgCfagsc | 1045 | (NAG37)s(invAb)sgcugcucuCfCfAfuagaiauccas(invAb) | 1268 |
| AD09734 | usUfsusGfaAfugcugAfgAfaAfuAfcusc | 1046 | (NAG37)s(invAb)sgaguauuuCfUfCfagcauucaaas(invAb) | 1269 |
| AD09735 | usCfsusAfuGfgacuuGfaUfcUfuGfgcsg | 1047 | (NAG37)s(invAb)scgccaagaUfCfAfaguccauagas(invAb) | 1270 |
| AD09736 | asUfsgsAfaAfcaaacAfaAfcCfcUfggsa | 1048 | (NAG37)s(invAb)succaggguUfUfGfuuuguuucaus(invAb) | 1271 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD09737 | usGfsgsUfaGfuucuuCfaUfaGfgUfgasc | 1049 | (NAG37)s(invAb)sgucaccuaUfGfAfagaacuaccas(invAb) | 1272 |
| AD09738 | usGfsasUfaAfuggcuGfgUfaGfuUfcusc | 1050 | (NAG37)s(invAb)sgagaacuaCfCfAfgccauuaucas(invAb) | 1273 |
| AD09739 | usCfsusCfaAfuugugAfuAfaUfgGfcusg | 1051 | (NAG37)s(invAb)scagccauuAfUfCfacaauugagas(invAb) | 1274 |
| AD09740 | usCfsusUfuCfucgauCfuUfcAfgCfucsa | 1052 | (NAG37)s(invAb)sugagcugaAfGfAfucgagaaagas(invAb) | 1275 |
| AD09741 | usUfsusGfgAfacagcAfaUfgGfuGfcasg | 1053 | (NAG37)s(invAb)scugcaccaUfUfGfcuguuccaaas(invAb) | 1276 |
| AD09742 | usGfsusAfgAfcacaaAfgAfgCfuCfcasc | 1054 | (NAG37)s(invAb)sguggagcuCfUfUfuguguuuacas(invAb) | 1277 |
| AD09743 | usCfsusGfuGfuagacAfcAfaAfgAfgcsu | 1055 | (NAG37)s(invAb)sagcucuuuGfUfGfucuacacaias(invAb) | 1278 |
| AD09744 | usUfscsCfaUfaauacUfcUfgAfgAfgasg | 1056 | (NAG37)s(invAb)scucucucaGfAfGfuauuauggaas(invAb) | 1279 |
| AD09745 | usCfsusCfgUfuccauAfaUfaCfuCfugsc | 1057 | (NAG37)s(invAb)sgcagaguaUfUfAfuggaacgaias(invAb) | 1280 |
| AD09937 | cPrpusUfsgsAfaAfcaaacAfaAfcCfcUfgg sa | 1058 | (NAG37)s(invAb)succaggguUfUfGfuuuguuucaas(invAb) | 1281 |
| AD09938 | cPrpusUfscsCfaUfaauacUfcUfgAfgAfga sg | 1059 | (NAG37)s(invAb)scucucucaGfAfGfuauuauggaas(invAb) | 1279 |
| AD09962 | asAfsusGfaaacaaaCfaAfaCfccugsg | 1060 | (NAG37)s(invAb)sccaggguuUfGfUfuuguuucauus(invAb) | 1282 |
| AD09963 | asAfsasUfgaaacaaAfcAfaAfcccusg | 1061 | (NAG37)s(invAb)scaggguuuGfUfUfuguuucauuus(invAb) | 1283 |
| AD09964 | usGfsasAfaugaaacAfaAfcAfaaccsc | 1062 | (NAG37)s(invAb)sggguuuguUfUfGfuuucauuucas(invAb) | 1284 |
| AD09965 | usUfsgsAfaAfcaaacAfaAfcCfcUfggsa | 1063 | (NAG37)s(invAb)succaggguUfUfGfuuuguuucaas(invAb) | 1281 |
| AD09966 | cPrpusUfsgsAfaacaaacAfaAfcCfcuggsa | 1064 | (NAG37)s(invAb)succaggguUfUfGfuuuguuucaas(invAb) | 1281 |
| AD09967 | cPrpuUfgAfaacaaacAfaAfcCfcuggsa | 1065 | (NAG37)s(invAb)succaggguUfUfGfuuuguuucaas(invAb) | 1281 |
| AD09968 | cPrpuUfgAfaacaaacAfaAfcCfcugsgsa | 1066 | (NAG37)s(invAb)succaggguUfUfGfuuuguuucaas(invAb) | 1281 |
| AD09969 | cPrpuUfgAfaacaaacAfaAfcCfcuggsa | 1065 | (NAG37)s(invAb)succaggguUfuGfuUfuguuucaas(invAb) | 1285 |
| AD09970 | cPrpuUfgAfaacaaacAfaAfcCfcuggsa | 1065 | (NAG37)s(invAb)succaggguUfuGfUfuuguuucaas(invAb) | 1286 |
| AD09971 | asGfsasCfgaucauaCfuUfgGfagagsc | 1067 | (NAG37)s(invAb)sgcucuccaAfGfUfaugauciucus(invAb) | 1287 |
| AD09972 | asAfsgsGfcauucucAfaUfcUfccucsc | 1068 | (NAG37)s(invAb)sggaggagaUfUfGfagaauiccuus(invAb) | 1288 |
| AD09973 | usUfsusCfcuuggaaGfgCfaUfucucsg | 1069 | (NAG37)s(invAb)scgagaaugCfCfUfuccaaggaaas(invAb) | 1289 |
| AD09974 | usAfsgsAfuuuccuuGfgAfaGfgcausc | 1070 | (NAG37)s(invAb)sgaugccuuCfCfAfaggaaaucuas(invAb) | 1290 |
| AD09975 | asUfsasGfgaaacagCfaUfaUfucuusg | 1071 | (NAG37)s(invAb)sca_2NagaauaUfGfCfuguuuccuaus (invAb) | 1291 |
| AD09976 | usUfsgsAfugauguuCfcCfuCfcaacsg | 1072 | (NAG37)s(invAb)scguuggagGfGfAfacaucaucaas(invAb) | 1292 |
| AD09977 | usAfsgsAfacuugaaGfaAfgAfagcusg | 1073 | (NAG37)s(invAb)scagcuucuUfCfUfucaaguucuas(invAb) | 1293 |
| AD09978 | usAfscsCfaaugauaUfgCfcCfaacasc | 1074 | (NAG37)s(invAb)sguguugggCfAfUfaucauuggus(invAb) | 1294 |
| AD09979 | usCfsasUfggU$_{UNA}$guucUfgUfgUfagacsg | 1075 | (NAG37)s(invAb)scgucuacaCfAfGfaacaccaugas(invAb) | 1295 |
| AD09980 | usUfsgsAfgagagauCfcUfgGfgugusc | 1076 | (NAG37)s(invAb)sgacacccaGfGfAfucucuuucaas(invAb) | 1296 |
| AD09981 | usCfsasUfgauacugAfgAfgCfuugcsu | 1077 | (NAG37)s(invAb)sagcaagcuCfUfCfaguaucaugas(invAb) | 1297 |
| AD09982 | usUfsgsUfcaaccucAfcUfcUfuccgsa | 1078 | (NAG37)s(invAb)sucggaagaGfUfGfagguugacaas(invAb) | 1298 |
| AD09983 | usUfsusCfcaacaauUfcUfcCfuugusc | 1079 | (NAG37)s(invAb)sgacaaggaGfAfAfuuguuggaaas(invAb) | 1299 |
| AD09984 | usUfsgsAfguuagucUfcAfaAfgcugsc | 1080 | (NAG37)s(invAb)sgcagcuuuGfAfGfacuaacucaas(invAb) | 1300 |
| AD09985 | asUfsgsAfcaauaucUfgUfgCfggagsg | 1081 | (NAG37)s(invAb)sccuccgcaCfAfGfauauugucaus(invAb) | 1301 |

TABLE 5C-continued

| XDH RNAi Agent Duplexes Showing Chemically Modified Antisense Strand and Sense Strand Sequences | | | | |
|---|---|---|---|---|
| Sense Strand ID: | Modified Antisense Strand (5'→3') | SEQ ID NO. | Modified Sense Strand (5'→3') | SEQ ID NO. |
| AD09986 | usCfsasUfgacaauaUfcUfgUfgcggsa | 1082 | (NAG37)s(invAb)succgcacaGfAfUfauugucaugas(invAb) | 1302 |
| AD09987 | usCfsasAfagaagauAfgAfaGfcagcsc | 1083 | (NAG37)s(invAb)sggcugcuuCfUfAfucuucuugas(invAb) | 1303 |
| AD09988 | usCfsasCfguuauuaCfcUfgUfgugcsu | 1084 | (NAG37)s(invAb)sagcacacaGfGfUfaauaacguias(invAb) | 1304 |
| AD09989 | usAfsgsAfacuugagGfuUfaUfacagsg | 1085 | (NAG37)s(invAb)sccuguauaAfCfCfucaaguucuas(invAb) | 1305 |
| AD09990 | asUfsgsCfuuugcugUfuCfaUfuggusc | 1086 | (NAG37)s(invAb)sgaccaaugAfAfCfagcaaagcaus(invAb) | 1306 |
| AD09991 | usAfsgsUfauagauuCfaAfgGfuuausg | 1087 | (NAG37)s(invAb)sca_2NuaaccuUfGfAfaucuauacuas (invAb) | 1307 |
| AD09992 | asGfsasGfuaaucuuGfcUfuUfaugcsc | 1088 | (NAG37)s(invAb)sggcauaaaGfCfAfagauuacucus(invAb) | 1308 |
| AD09993 | asUfsasGfcaucauuUfcUfaGfguggsa | 1089 | (NAG37)s(invAb)succaccuaGfAfAfaugaugcuaus(invAb) | 1309 |
| AD09994 | asGfsasCfagaagagAfcAfgAfgcuasg | 1090 | (NAG37)s(invAb)scuagcucuGfUfCfucuucuiucus(invAb) | 1310 |
| AD09995 | asGfsusAfagaaaacCfaAfgCfcuuasg | 1091 | (NAG37)s(invAb)scua_2NaggcuUfGfGfuuuucuuacus (invAb) | 1311 |
| AD10008 | usUfscsCfauaauacUfcUfgAfgagasg | 1092 | (NAG37)s(invAb)scucucucaGfAfGfuauuauggaas(invAb) | 1279 |
| AD10009 | cPrpusUfscsCfauaauacUfcUfgAfgagasg | 1093 | (NAG37)s(invAb)scucucucaGfAfGfuauuauggaas(invAb) | 1279 |
| AD10010 | cPrpuUfcCfauaauacUfcUfgAfgagasg | 1094 | (NAG37)s(invAb)scucucucaGfAfGfuauuauggaas(invAb) | 1279 |
| AD10011 | cPrpuUfcCfauaauacUfcUfgAfgagsasg | 1095 | (NAG37)s(invAb)scucucucaGfAfGfuauuauggaas(invAb) | 1279 |
| AD10012 | cPrpuUfcCfauaauacUfcUfgAfgagasg | 1094 | (NAG37)s(invAb)scucucucaGfaGfuAfuuauggaas(invAb) | 1312 |
| AD10013 | cPrpuUfccauaaUfacUfcUfgAfgagasg | 1096 | (NAG37)s(invAb)scucucucaGfaGfuAfuuauggaas(invAb) | 1312 |
| AD10014 | cPrpuUfcCfauaauacUfcUfgAfgagasg | 1094 | (NAG37)s(invAb)scucucucaGfaGfUfauuauggaas(invAb) | 1313 |
| AD10015 | cPrpuUfccauaaUfacUfcUfgAfgagasg | 1096 | (NAG37)s(invAb)scucucucaGfaGfUfauuauggaas(invAb) | 1313 |
| AD10016 | usAfsusAfcuuggagAfgCfaUfcacusg | 1097 | (NAG37)s(invAb)scagugaugCfUfCfuccaaguauas(invAb) | 1314 |
| AD10017 | usUfsgsCfagacgauCfaUfaCfuuggsc | 1098 | (NAG37)s(invAb)sgccaaguaUfGfAfucgucuicaas(invAb) | 1315 |
| AD10018 | usUfsgsAfaUfaaaacUfcUfcAfugccsa | 1099 | (NAG37)s(invAb)suggcaugaGfAfGfuuuuauucaas(invAb) | 1316 |
| AD10019 | cPrpusUfsgsAfaUfaaaacUfcUfcAfugccsa | 1100 | (NAG37)s(invAb)suggcaugaGfAfGfuuuuauucaas(invAb) | 1316 |
| AD10020 | usUfsgsAfaUfaaaacUfcUfcAfugccsa | 1099 | (NAG37)s(invAb)suggcaugaGfAfGfuuuua_2Nuucaas (invAb) | 1317 |
| AD10021 | usAfscsUfuGfaAfgAfaGfaAfgCfuGfaGfsg | 1101 | (NAG37)s(invAb)sccucagcuUfCfUfucuucaaguas(invAb) | 1318 |
| AD10022 | usAfscsUfugaagaaGfaAfgCfugagsg | 1102 | (NAG37)s(invAb)sccucagcuUfCfUfucuucaaguas(invAb) | 1318 |
| AD10023 | cPrpusAfscsUfugaagaaGfaAfgCfugagsg | 1103 | (NAG37)s(invAb)sccucagcuUfCfUfucuucaaguas(invAb) | 1318 |
| AD10024 | cPrpuAfcUfugaagaaGfaAfgCfugagsg | 1104 | (NAG37)s(invAb)sccucagcuUfCfUfucuucaaguas(invAb) | 1318 |
| AD10025 | cPrpuAfcUfugaagaaGfaAfgCfugagsg | 1104 | (NAG37)s(invAb)sccucagcuUfCfUfucuuuaaguas(invAb) | 1319 |
| AD10026 | cPrpuAfcUfugaagaaGfaAfgCfugasgsg | 1105 | (NAG37)s(invAb)sccucagcuUfCfUfucuucaaguas(invAb) | 1318 |
| AD10027 | cPrpuAfcUfugaagaaGfaAfgCfugagsg | 1104 | (NAG37)s(invAb)sccucagcuUfcUfUfcuucaaguas(invAb) | 1320 |
| AD10028 | cPrpuAfcUfugaagaaGfaAfgCfugagsg | 1104 | (NAG37)s(invAb)sccucagcuUfcUfuCfuucaaguas(invAb) | 1321 |
| AD10029 | cPrpuAfcuugAfagaaGfaAfgCfugagsg | 1106 | (NAG37)s(invAb)sccucagcuUfcUfuCfuucaaguas(invAb) | 1321 |
| AD10030 | cPrpuAfcuugaaGfaaGfaAfgCfugagsg | 1107 | (NAG37)s(invAb)sccucagcuUfcUfUfcuucaaguas(invAb) | 1320 |
| AD10091 | cPrpusUfsusGfaAfugcugAfgAfaAfuAfcu sc | 1108 | (NAG37)s(invAb)sgaguauuuCfUfCfagcauucaaas(invAb) | 1269 |
| AD10092 | cPrpusUfsusGfaaugcugAfgAfaAfuacusc | 1109 | (NAG37)s(invAb)sgaguauuuCfUfCfagcauucaaas(invAb) | 1269 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD10093 | cPrpusUfsusgaaUfgcugAfgAfaAfuacusc | 1110 | (NAG37)s(invAb)sgaguauuuCfUfCfagcauucaaas(invAb) | 1269 |
| AD10094 | cPrpusUfsusGfaaugcugAfgAfaAfuacusc | 1109 | (NAG37)s(invAb)sgaguauuuCfuCfAfgcauucaaas(invAb) | 1322 |
| AD10095 | cPrpusUfsusgaaUfgcugAfgAfaAfuacusc | 1110 | (NAG37)s(invAb)sgaguauuuCfuCfAfgcauucaaas(invAb) | 1322 |
| AD10096 | cPrpuUfuGfaaugcugAfgAfaAfuacusc | 1111 | (NAG37)s(invAb)sgaguauuuCfUfCfagcauucaaas(invAb) | 1269 |
| AD10097 | cPrpuUfuGfaaugcugAfgAfaAfuacsusc | 1112 | (NAG37)s(invAb)sgaguauuuCfUfCfagcauucaaas(invAb) | 1269 |
| AD10099 | asGfsasAfaAfguggaCfgAfuCfuUfgusc | 1113 | (NAG37)s(invAb)sgacaagauCfGfUfccacuuuucus(invAb) | 1323 |
| AD10100 | usAfsgsUfuGfucacuGfcAfaCfaUfggsu | 1114 | (NAG37)s(invAb)saccauguuGfCfAfgugacaacuas(invAb) | 1324 |
| AD10101 | asUfsusCfcUfuccacAfgUfuGfuCfacsc | 1115 | (NAG37)s(invAb)sggugacaaCfUfGfuggaaggaaus(invAb) | 1325 |
| AD10102 | usGfscsAfuUfcucaaUfcUfcCfuCfcasc | 1116 | (NAG37)s(invAb)sguggaggaGfAfUfugagaaugcas(invAb) | 1326 |
| AD10103 | usUfscsAfaUfgccaaUfcUfcCfgUfgusc | 1117 | (NAG37)s(invAb)sgacacggaGfAfUfuggcauugaas(invAb) | 1327 |
| AD10104 | asUfsasUfuCfuugaaCfuUfcAfuCfucsg | 1118 | (NAG37)s(invAb)scgagaugaAfGfUfucaagaaua_2Nus (invAb) | 1328 |
| AD10105 | usUfsasUfgGfagagcAfgUfaUfcUfccsu | 1119 | (NAG37)s(invAb)saggagauaCfUfGfcucuccauaas(invAb) | 1329 |
| AD10106 | usAfsasUfgCfugagaAfaUfaCfuCfccsc | 1120 | (NAG37)s(invAb)sggggaguaUfUfUfcucagcauuas(invAb) | 1330 |
| AD10107 | usGfsasAfuGfcugagAfaAfuAfcUfccsc | 1121 | (NAG37)s(invAb)sgggaguauUfUfCfucagcauucas(invAb) | 1331 |
| AD10108 | usCfsasAfuGfucaucUfuCfuCfuCfcgsg | 1122 | (NAG37)s(invAb)sccggagagAfAfGfaugacauugas(invAb) | 1332 |
| AD10109 | asCfsasAfaUfuccagUfuAfuGfuUfacsc | 1123 | (NAG37)s(invAb)sgguaacauAfAfCfuggaauuugus(invAb) | 1333 |
| AD10110 | usUfscsAfaUfugugaUfaAfuGfgCfugsg | 1124 | (NAG37)s(invAb)sccagccauUfAfUfcacaauugaas(invAb) | 1334 |
| AD10111 | asAfscsAfuUfuuugcAfaCfaAfaGfcusc | 1125 | (NAG37)s(invAb)sgagcuuugUfUfGfcaaaaauguus(invAb) | 1335 |
| AD10112 | usCfsasAfcAfuuuuuGfcAfaCfaAfagsc | 1126 | (NAG37)s(invAb)sgcuuuguuGfCfAfaaaauguugas(invAb) | 1336 |
| AD10113 | usUfsusCfaCfucgaaCfcAfcAfaUfccsg | 1127 | (NAG37)s(invAb)scggauuguGfGfUfucgagugaaas(invAb) | 1337 |
| AD10176 | cPrpusCfsusUfaUfuccaaAfcUfuGfgUfgg sg | 1128 | (NAG37)s(invAb)scccaccaaGfUfUfuggaauaagas(invAb) | 1201 |
| AD10177 | cPrpuCfuUfaUfuccaaAfcUfuGfgUfggsg | 1129 | (NAG37)s(invAb)scccaccaaGfUfUfuggaauaagas(invAb) | 1201 |
| AD10178 | cPrpuCfuuauucCfaaAfcUfuGfguggsg | 1130 | (NAG37)s(invAb)scccaccaaGfUfUfuggaauaagas(invAb) | 1201 |
| AD10179 | cPrpuCfuuauucCfaaAfcUfuGfguggsg | 1130 | (NAG37)s(invAb)scccaccaaGfuUfuGfgaauaagas(invAb) | 1338 |
| AD10180 | cPrpuCfuuauucCfaaAfcUfuGfguggsg | 1130 | (NAG37)s(invAb)scccaccaaGfuUfUfggaauaagas(invAb) | 1339 |
| AD10181 | cPrpuGfcauauucacCfaUfuUfaggcsa | 1131 | (NAG37)s(invAb)sugccuaAfaUfgGfugaauaugcas(invAb) | 1223 |
| AD10182 | cPrpuGfcauaUfucacCfaUfuUfaggcsa | 1132 | (NAG37)s(invAb)sugccuaaaUfgGfuGfaauaugcas(invAb) | 1340 |
| AD10183 | cPrpuGfcauauuCfacCfaUfuUfaggcsa | 1133 | (NAG37)s(invAb)sugccuaaaUfgGfuGfaauaugcas(invAb) | 1340 |
| AD10184 | cPrpuGfcauaUfucacCfaUfuUfaggcsa | 1132 | (NAG37)s(invAb)sugccuaaaUfgGfUfgaauaugcas(invAb) | 1341 |
| AD10200 | usGfscauauucacCfaUfuUfaggcsa | 1134 | (NAG37)s(invAb)sugccuaAfaUfgGfugaauaugcas(invAb) | 1223 |
| AD10201 | usGfscauaUfucacCfaUfuUfaggcsa | 1135 | (NAG37)s(invAb)sugccuaAfaUfgGfugaauaugcas(invAb) | 1223 |
| AD10202 | usGfscauauuCfacCfaUfuUfaggcsa | 1136 | (NAG37)s(invAb)sugccuaAfaUfgGfugaauaugcas(invAb) | 1223 |
| AD10203 | usGfscauaUfucacCfaUfuUfaggcsa | 1135 | (NAG37)s(invAb)sugccuaaaUfgGfuGfaauaugcas(invAb) | 1340 |
| AD10204 | usGfscauauuCfacCfaUfuUfaggcsa | 1136 | (NAG37)s(invAb)sugccuaaaUfgGfuGfaauaugcas(invAb) | 1340 |
| AD10205 | usGfscauaUfucacCfaUfuUfaggcsa | 1135 | (NAG37)s(invAb)sugccuaaaUfgGfUfgaauaugcas(invAb) | 1341 |
| AD10275 | cPrpasUfsgsAfaacaaacAfaAfcCfcuggsa | 1137 | (NAG37)s(invAb)succaggguUfUfGfuuuguuucaus(invAb) | 1271 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD10276 | cPrpasUfsgsAfaacaaacAfaAfcCfcugsgsa | 1138 | (NAG37)s(invAb)succagggguUfUfGfuuuguuucaus(invAb) | 1271 |
| AD10277 | cPrpasUfsgAfaacaaacAfaAfcCfcugsgsa | 1139 | (NAG37)s(invAb)succaggguUfUfGfuuuguuucaus(invAb) | 1271 |
| AD10278 | cPrpaUfgAfaacaaacAfaAfcCfcugsgsa | 1140 | (NAG37)s(invAb)succaggguUfUfGfuuuguuucaus(invAb) | 1271 |
| AD10279 | cPrpasUfsgAfaacaaacAfaAfcCfcugsgsa | 1139 | (NAG37)s(invAb)succaggguUfuGfuUfuguuucaus(invAb) | 1342 |
| AD10280 | cPrpasUfsgaaacaAfacAfaAfcCfcugsgsa | 1141 | (NAG37)s(invAb)succaggguUfuGfuUfuguuucaus(invAb) | 1342 |
| AD10281 | cPrpasUfsgaaaCfaaacAfaAfcCfcugsgsa | 1142 | (NAG37)s(invAb)succaggguUfuGfuUfuguuucaus(invAb) | 1342 |
| AD10282 | cPrpasUfsgaAfacaaacAfaAfcCfcugsgsa | 1143 | (NAG37)s(invAb)succaggguUfuGfuUfuguuucaus(invAb) | 1342 |
| AD10283 | cPrpasUfsgAfaaCfaAfacAfaAfcCfcugsg sa | 1144 | (NAG37)s(invAb)succaggguUfuGfuUfuguuucaus(invAb) | 1342 |
| AD10619 | cPrpusUfscsCfauaauacUfcUfgAfgagasg | 1093 | (NAG37)s(invAb)scucucucaGfaGfuAfuuauggaas(invAb) | 1312 |
| AD10620 | cPrpusUfscCfauaauacUfcUfgAfgagasg | 1145 | (NAG37)s(invAb)scucucucaGfaGfuAfuuauggaas(invAb) | 1312 |
| AD10621 | cPrpusUfscCfauaauacUfcUfgAfgagsasg | 1146 | (NAG37)s(invAb)scucucucaGfaGfuAfuuauggaas(invAb) | 1312 |
| AD10622 | cPrpuUfcCfauaauacUfcUfgAfgagsasg | 1095 | (NAG37)s(invAb)scucucucaGfaGfuAfuuauggaas(invAb) | 1312 |
| AD10623 | cPrpuUfcCfauaauacUfcUfgAfgagasc | 1147 | (NAG37)s(invAb)sgucucucaGfaGfuAfuuauggaas(invAb) | 1343 |
| AD10624 | cPrpuUfcCfauaauacUfcUfgAfgaggsg | 1148 | (NAG37)s(invAb)scccucucaGfaGfuAfuuauggaas(invAb) | 1344 |
| AD10625 | cPrpuUfcCfauaauacUfcUfgAfgaggsc | 1149 | (NAG37)s(invAb)sgccucucaGfaGfuAfuuauggaas(invAb) | 1345 |
| AD10626 | cPrpuUfcCfauaauacUfcUfgAfgaggsu | 1150 | (NAG37)s(invAb)saccucucaGfaGfuAfuuauggaas(invAb) | 1346 |
| AD10627 | cPrpuUfcCfauaauacUfcUfgAfgaggsa | 1151 | (NAG37)s(invAb)succucucaGfaGfuAfuuauggaas(invAb) | 1347 |
| AD10628 | cPrpuUfccauAfauacUfcUfgAfgagasg | 1152 | (NAG37)s(invAb)scucucucaGfaGfuAfuuauggaas(invAb) | 1312 |
| AD10629 | cPrpusGfscsauauuCfacCfaUfuUfaggcsa | 1153 | (NAG37)s(invAb)sugccuaaaUfgGfuGfaauaugcas(invAb) | 1340 |
| AD10630 | cPrpusGfscauauuCfacCfaUfuUfaggcsa | 1154 | (NAG37)s(invAb)sugccuaaaUfgGfuGfaauaugcas(invAb) | 1340 |
| AD10631 | cPrpusGfscauauuCfacCfaUfuUfaggscsa | 1155 | (NAG37)s(invAb)sugccuaaaUfgGfuGfaauaugcas(invAb) | 1340 |
| AD10632 | cPrpuGfcauauuCfacCfaUfuUfaggscsa | 1156 | (NAG37)s(invAb)sugccuaaaUfgGfuGfaauaugcas(invAb) | 1340 |
| AD10633 | cPrpusGfscsauaUfucacCfaUfuUfaggcsa | 1157 | (NAG37)s(invAb)sugccuaaaUfgGfUfgaauaugcas(invAb) | 1341 |
| AD10634 | cPrpusGfscauaUfucacCfaUfuUfaggcsa | 1158 | (NAG37)s(invAb)sugccuaaaUfgGfUfgaauaugcas(invAb) | 1341 |
| AD10635 | cPrpusGfscauaUfucacCfaUfuUfaggscsa | 1159 | (NAG37)s(invAb)sugccuaaaUfgGfUfgaauaugcas(invAb) | 1341 |
| AD10636 | cPrpuGfcauaUfucacCfaUfuUfaggscsa | 1160 | (NAG37)s(invAb)sugccuaaaUfgGfUfgaauaugcas(invAb) | 1341 |
| AD10728 | asUfsgsAfcaauaucUfgUfgCfggagsg | 1081 | (NAG37)s(invAb)sccuccgcaCfaGfaUfauugucaus(invAb) | 1348 |
| AD10729 | asUfsgsacaAfuaucUfgUfgCfggagsg | 1161 | (NAG37)s(invAb)sccuccgcaCfaGfaUfauugucaus(invAb) | 1348 |
| AD10730 | asUfsgsacaauAfucUfgUfgCfggagsg | 1162 | (NAG37)s(invAb)sccuccgcaCfaGfaUfauugucaus(invAb) | 1348 |
| AD10731 | cPrpasUfsgsacaauAfucUfgUfgCfggagsg | 1163 | (NAG37)s(invAb)sccuccgcaCfaGfaUfauugucaus(invAb) | 1348 |
| AD10732 | cPrpusUfsgsacaauAfucUfgUfgCfggagsg | 1164 | (NAG37)s(invAb)sccuccgcaCfaGfaUfauugucaas(invAb) | 1349 |
| AD10733 | cPrpaUfgacaauAfucUfgUfgCfggagsg | 1165 | (NAG37)s(invAb)sccuccgcaCfaGfaUfauugucaus(invAb) | 1348 |
| AD10734 | cPrpaUfgacaauAfucUfgUfgCfggasgsg | 1166 | (NAG37)s(invAb)sccuccgcaCfaGfaUfauugucaus(invAb) | 1348 |
| AD10735 | cPrpasUfsgacaauAfucUfgUfgCfggasgsg | 1167 | (NAG37)s(invAb)sccuccgcaCfaGfaUfauugucaus(invAb) | 1348 |
| AD10736 | cPrpasUfsgsacaauAfucUfgUfgCfggasg | 1168 | (NAG37)s(invAb)scuccgcaCfaGfaUfauugucaus(invAb) | 1350 |
| AD10737 | cPrpasUfsgsacaauAfucUfgUfgCfggsa | 1169 | (NAG37)s(invAb)succgcaCfaGfaUfauugucaus(invAb) | 1351 |
| AD10952 | cPrpusUfsccauaaUfacUfcUfgAfgagsasg | 1170 | (NAG37)s(invAb)scucucucaGfaGfuAfuuauggaas(invAb) | 1312 |

TABLE 5C-continued

XDH RNAi Agent Duplexes Showing Chemically Modified Antisense Strand and Sense Strand Sequences

| Sense Strand ID: | Modified Antisense Strand (5'→3') | SEQ ID NO. | Modified Sense Strand (5'→3') | SEQ ID NO. |
|---|---|---|---|---|
| AD10953 | cPrpusUfscCfauaauacUfcUfgAfgagsasc | 1171 | (NAG37)s(invAb)sgucucucaGfaGfuAfuuauggaas(invAb) | 1343 |
| AD10954 | cPrpusUfsgaaaCfaaacAfaAfcCfcugsgsa | 1172 | (NAG37)s(invAb)succaggguUfuGfuUfuguuucaas(invAb) | 1285 |
| AD10967 | asUfsgsAfaAfcaaacAfaAfcCfcUfggsa | 1048 | (NAG37)s(invAb)succaggguUfuGfuUfuguuucaus(invAb) | 1342 |
| AD10968 | asUfsgAfaAfcaaacAfaAfcCfcUfgsgsa | 1173 | (NAG37)s(invAb)succaggguUfuGfuUfuguuucaus(invAb) | 1342 |
| AD10969 | asUfsgAfaacaaacAfaAfcCfcugsgsa | 1174 | (NAG37)s(invAb)succaggguUfuGfuUfuguuucaus(invAb) | 1342 |
| AD12167 | asCfsucgUfuccauaaUfaCfucugasgsa | 1672 | (NAG37)suscagagUfaUfUfAfuggaacgagus(invAb) | 1676 |
| AD12168 | asUfsccaUfaauacucUfgAfgagagsasu | 1673 | (NAG37)scsucucuCfaGfAfGfuauuauggaus(invAb) | 1677 |

In some aspects, an XDH RNAi agent is prepared or provided as a salt, mixed salt, or a free-acid. The RNAi agents described herein, upon delivery to a cell expressing an XDH gene, inhibit or knockdown expression of one or more XDH genes in vivo and/or in vitro.

Targeting Ligands or Groups, Linking Groups, and Delivery Vehicles

In some aspects, an XDH RNAi agent is conjugated to one or more non-nucleotide groups including, but not limited to, a targeting group, a linking group, a targeting ligand, a delivery polymer, or a delivery vehicle. The non-nucleotide group can enhance targeting, delivery or attachment of the RNAi agent. Examples of targeting groups and linking groups are provided in Table 6. The non-nucleotide group can be covalently linked to the 3' and/or 5' end of either the sense strand and/or the antisense strand. In some aspects, an XDH RNAi agent contains a non-nucleotide group linked to the 3' and/or 5' end of the sense strand. In some aspects, a non-nucleotide group is linked to the 5' end of an XDH RNAi agent sense strand. A non-nucleotide group may be linked directly or indirectly to the RNAi agent via a linker/linking group. In some aspects, a non-nucleotide group is linked to the RNAi agent via a labile, cleavable, or reversible bond or linker.

In some aspects, a non-nucleotide group enhances the pharmacokinetic or biodistribution properties of an RNAi agent or conjugate to which it is attached to improve cell- or tissue-specific distribution and cell-specific uptake of the RNAi agent or conjugate. In some aspects, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be monovalent, divalent, trivalent, tetravalent, or have higher valency for the target to which it is directed. Representative targeting groups include, without limitation, compounds with affinity to cell surface molecules, cell receptor ligands, haptens, antibodies, monoclonal antibodies, antibody fragments, and antibody mimics with affinity to cell surface molecules.

In some aspects, a targeting group is linked to an RNAi agent using a linker, such as a PEG linker or one, two, or three abasic and/or ribitol (abasic ribose) residues, which can in some instances serve as linkers. In some aspects, a targeting ligand comprises a galactose-derivative cluster.

The XDH RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

In some aspects, a targeting group comprises an asialoglycoprotein receptor ligand. As used herein, an asialoglycoprotein receptor ligand is a ligand that contains a moiety having affinity for the asialoglycoprotein receptor. As noted herein, the asialoglycoprotein receptor is highly expressed on hepatocytes. In some aspects, an asialoglycoprotein receptor ligand includes or consists of one or more galactose derivatives. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formylgalactosamine, N-acetyl-galactosamine, N-propionyl-galactosamine, N-n-butanoyl-galactosamine, and N-iso-butanoylgalactos-amine (see for example: S. T. Iobst and K. Drickamer, J. B. C., 1996, 271, 6686). Galactose derivatives, and clusters of galactose derivatives, that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945).

Galactose derivatives have been used to target molecules to hepatocytes in vivo through their binding to the asialoglycoprotein receptor expressed on the surface of hepatocytes. Binding of asialoglycoprotein receptor ligands to the asialoglycoprotein receptor(s) facilitates cell-specific targeting to hepatocytes and endocytosis of the molecule into hepatocytes. Asialoglycoprotein receptor ligands can be monomeric (e.g., having a single galactose derivative, also referred to as monovalent or monodentate) or multimeric (e.g., having multiple galactose derivatives). The galactose derivative or galactose derivative cluster can be attached to the 3' or 5' end of the sense or antisense strand of the RNAi agent using methods known in the art. The preparation of targeting ligands, such as galactose derivative clusters, is described in, for example, International Patent Application Publication No. WO 2018/044350 to Arrowhead Pharmaceuticals, Inc., and International Patent Application Publication No. WO 2017/156012 to Arrowhead Pharmaceuticals, Inc., the contents of both of which are incorporated by reference herein in their entirety.

As used herein, a galactose derivative cluster comprises a molecule having two to four terminal galactose derivatives. A terminal galactose derivative is attached to a molecule through its C-1 carbon. In some aspects, the galactose derivative cluster is a galactose derivative trimer (also referred to as tri-antennary galactose derivative or tri-valent galactose derivative). In some aspects, the galactose derivative cluster comprises N-acetyl-galactosamine moieties. In some aspects, the galactose derivative cluster comprises three N-acetyl-galactosamine moieties. In some aspects, the galactose derivative cluster is a galactose derivative tetramer (also referred to as tetra-antennary galactose derivative or tetra-valent galactose derivative). In some aspects, the galactose derivative cluster comprises four N-acetyl-galactosamine moieties.

As used herein, a galactose derivative trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some aspects, the galactose derivatives are linked to the branch point via linkers or spacers. In some aspects, the linker or spacer is a flexible hydrophilic spacer, such as a PEG group (see, e.g., U.S. Pat. No. 5,885,968; Biessen et al. J. Med. Chem. 1995 Vol. 39 p. 1538-1546). In some aspects, the PEG spacer is a PEGS spacer. The branch point can be any small molecule which permits attachment of three galactose derivatives and further permits attachment of the branch point to the RNAi agent. An example of branch point group is a di-lysine or di-glutamate. Attachment of the branch point to the RNAi agent can occur through a linker or spacer. In some aspects, the linker or spacer comprises a flexible hydrophilic spacer, such as, but not limited to, a PEG spacer. In some aspects, the linker comprises a rigid linker, such as a cyclic group. In some aspects, a galactose derivative comprises or consists of N-acetyl-galactosamine. In some aspects, the galactose derivative cluster is comprised of a galactose derivative tetramer, which can be, for example, an N-acetyl-galactosamine tetramer.

Certain aspects of the present disclosure include pharmaceutical compositions for delivering an XDH RNAi agent to a liver cell in vivo. Such pharmaceutical compositions can include, for example, an XDH RNAi agent conjugated to a galactose derivative cluster. In some aspects, the galactose derivative cluster is comprised of a galactose derivative trimer, which can be, for example, an N-acetyl-galactosamine trimer, or galactose derivative tetramer, which can be, for example, an N-acetyl-galactosamine tetramer.

A targeting ligand or targeting group can be linked to the 3' or 5' end of a sense strand or an antisense strand of an XDH RNAi agent disclosed herein.

Targeting ligands include, but are not limited to (NAG37) and (NAG37)s as defined in Table 6. Other targeting groups and targeting ligands, including galactose cluster targeting ligands, are known in the art.

In some aspects, a linking group is conjugated to the RNAi agent. The linking group facilitates covalent linkage of the agent to a targeting group, delivery polymer, or delivery vehicle. The linking group can be linked to the 3' and/or the 5' end of the RNAi agent sense strand or antisense strand. In some aspects, the linking group is linked to the RNAi agent sense strand. In some aspects, the linking group is conjugated to the 5' or 3' end of an RNAi agent sense strand. In some aspects, a linking group is conjugated to the 5' end of an RNAi agent sense strand. Examples of linking groups, can include, but are not limited to: reactive groups such a primary amines and alkynes, alkyl groups, abasic nucleotides, ribitol (abasic ribose), and/or PEG groups.

In some aspects, a targeting group is linked internally to a nucleotide on the sense strand and/or the antisense strand of the RNAi agent. In some aspects, a targeting group is linked to the RNAi agent via a linker.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage can optionally include a spacer that increases the distance between the two joined atoms. A spacer can further add flexibility and/or length to the linkage. Spacers include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

In some aspects, when two or more RNAi agents are included in a single composition, each of the RNAi agents may be linked to the same targeting group or two a different targeting groups (i.e., targeting groups having different chemical structure). In some aspects, targeting groups are linked to the XDH RNAi agents disclosed herein without the use of an additional linker. In some aspects, the targeting group itself is designed having a linker or other site to facilitate conjugation readily present. In some aspects, when two or more XDH RNAi agents are included in a single molecule, each of the RNAi agents may utilize the same linker or different linkers (i.e., linkers having different chemical structures).

Any of the XDH RNAi agent nucleotide sequences listed in Tables 2, 3, 4, or 5C, whether modified or unmodified, can contain 3' and/or 5' targeting group(s) or linking group(s). Any of the XDH RNAi agent sequences listed in Table 3 or 4, or are otherwise described herein, which contain a 3' or 5' targeting group or linking group, can alternatively contain no 3' or 5' targeting group or linking group, or can contain a different 3' or 5' targeting group or linking group including, but not limited to, those depicted in Table 6. Any of the XDH RNAi agent duplexes listed in Tables 5A, 5B and 5C, whether modified or unmodified, can further comprise a targeting group or linking group, including, but not limited to, those depicted in Table 6, and the targeting group or linking group can be attached to the 3' or 5' terminus of either the sense strand or the antisense strand of the XDH RNAi agent duplex.

Examples of targeting groups and linking groups (which when combined can form targeting ligands) are provided in Table 6. Table 4 and Table 5C provide several aspects of XDH RNAi agent sense strands having a targeting group or linking group linked to the 5' or 3' end.

TABLE 6
Structures Representing Various Modified Nucleotides, Targeting Ligands or Targeting Groups, Capping Residues, and Linking Groups
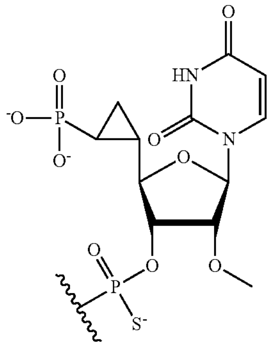
cPrpus
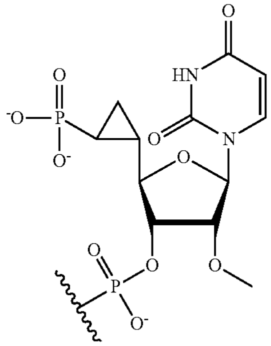
cPrpu
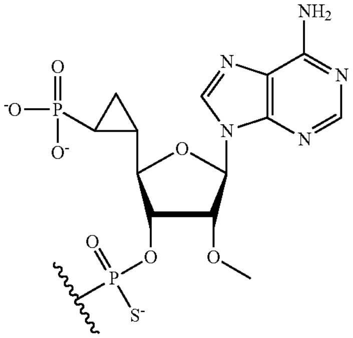
cPrpas
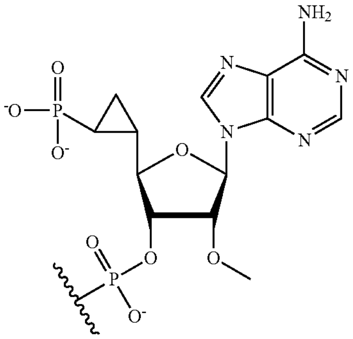
cPrpa TABLE 6-continued
| Structures Representing Various Modified Nucleotides, Targeting Ligands or Targeting Groups, Capping Residues, and Linking Groups |
|---|
| 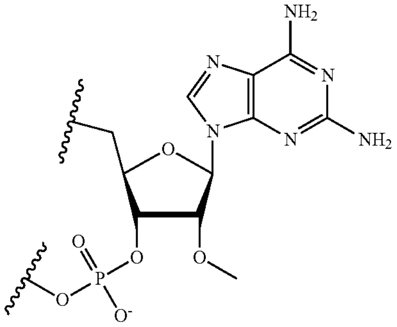 |
| a_2N |
| 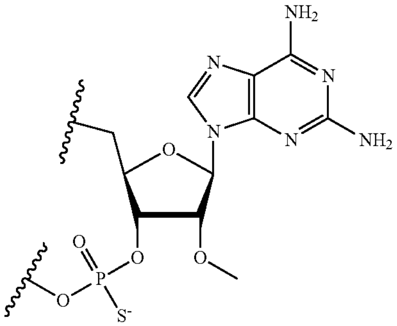 |
| a_2Ns |
| 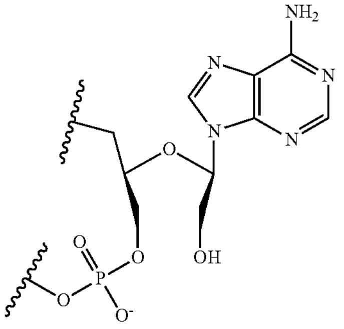 |
| AUNA |
| 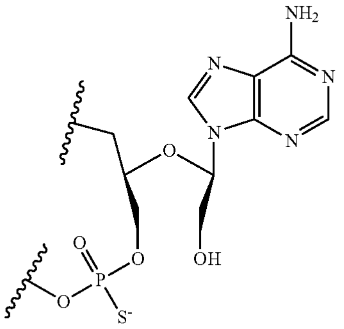 |
| AUNAS |

TABLE 6-continued
| Structures Representing Various Modified Nucleotides, Targeting Ligands or Targeting Groups, Capping Residues, and Linking Groups |
| --- |
| 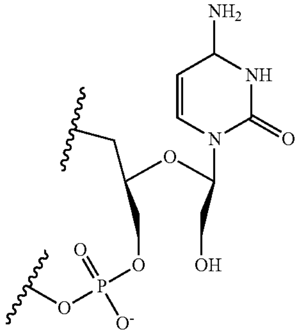 [SMILES: *C[C@H](COP(=O)([O-])O*)O[C@H](CO)N1C=CC(N)NC1=O] |
| CUNA |
| 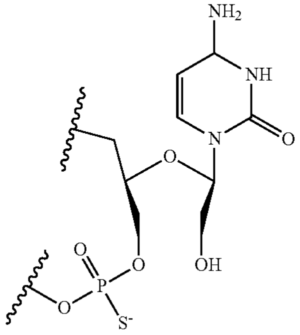 |
| CUNAS |
| 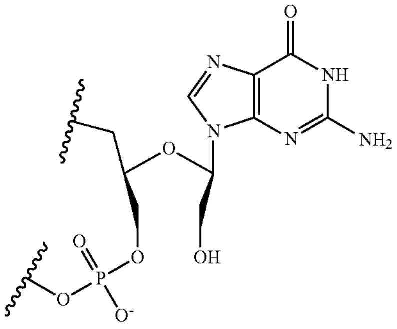 |
| GUNA |
| 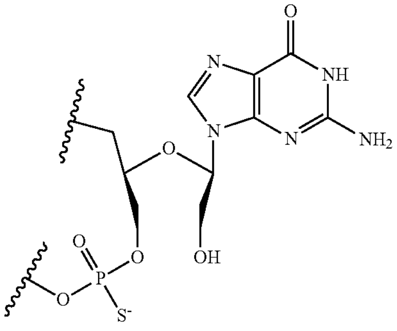 |
| GUNAS |

TABLE 6-continued

| Structures Representing Various Modified Nucleotides, Targeting Ligands or Targeting Groups, Capping Residues, and Linking Groups |
|---|
| 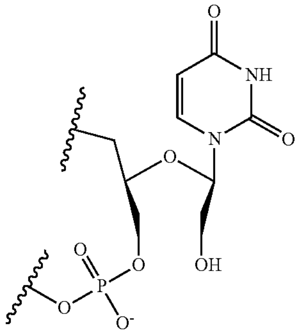 [SMILES: *C[C@H](COP(=O)([O-])O*)O[C@H](CO)n1ccc(=O)[nH]c1=O]<br>UUNA<br>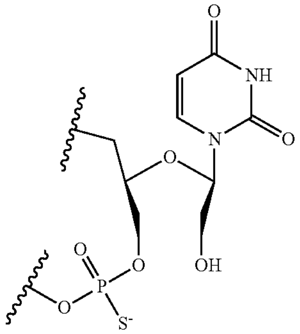<br>UUNAS<br>When positioned internally:<br>linkage towards 5' end<br>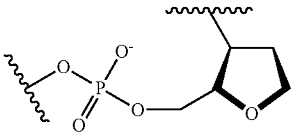<br>linkage towards 3' end<br>(inv Ab)<br>When positioned internally:<br>linkage towards 5' end<br>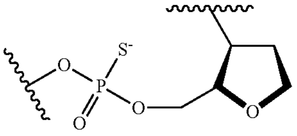<br>linkage towards 3' end<br>(inv Ab)s<br>When positioned at the 3' terminal end:<br>linkage towards 5' end<br>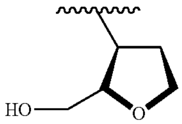<br>(inv Ab) |

TABLE 6-continued

| Structures Representing Various Modified Nucleotides, Targeting Ligands or Targeting Groups, Capping Residues, and Linking Groups |
|---|
| 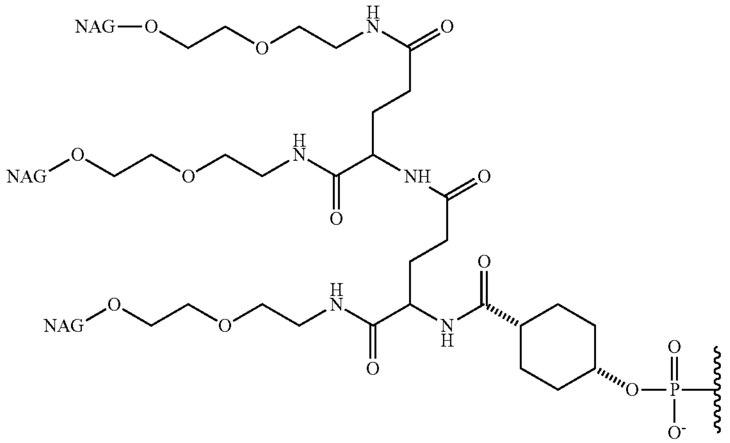 |
| (NAG37) |
| 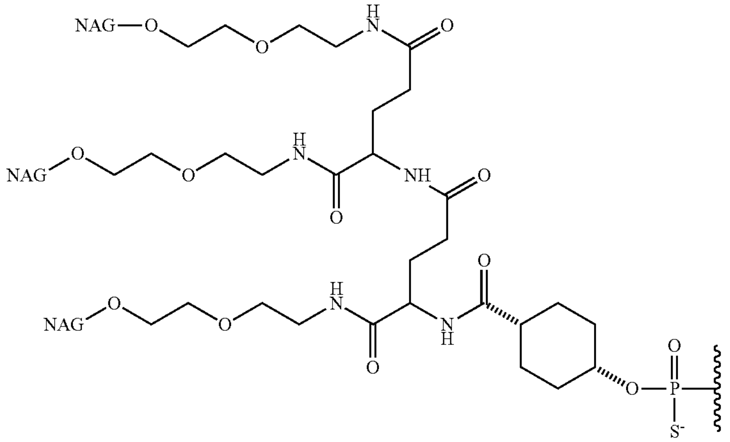 |
| (NAG37)s |
| 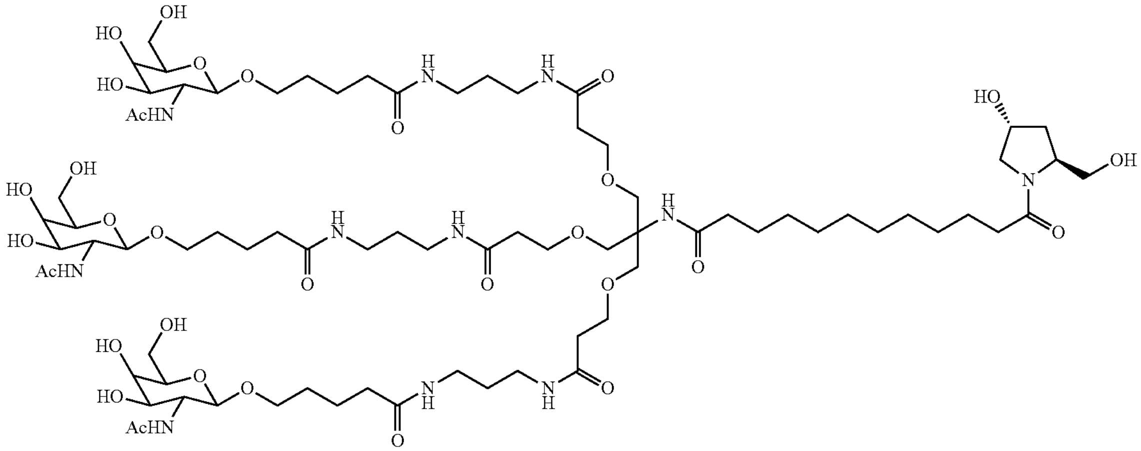 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2CO)OC(CO)C(O)C1O] |
| N-[tris(GalNac-alkyl)-amidodecanoyl)]-4-hydroxyprolinol (Hyp-GalNac-alkyl)3) |

In each of the above structures in Table 6, NAG comprises an N-acetyl-galactosamine or another galactose derivative, as would be understood by a person of ordinary skill in the art to be attached in view of the structures above and description provided herein. Other linking groups known in the art may be used.

In some aspects, a delivery vehicle can be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine. In some aspects, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see, for example WO 2000/053722, WO 2008/0022309, WO 2011/104169, and WO 2012/083185, WO 2013/032829, WO 2013/158141, each of which is incorporated herein by reference), hydrogels, cyclodextrins, biodegradable nanocapsules, and bioadhesive microspheres, proteinaceous vectors, or other delivery systems suitable for nucleic acid or oligonucleotide delivery as known and available in the art.

Pharmaceutical Compositions and Formulations

The XDH RNAi agents disclosed herein can be prepared as pharmaceutical compositions or formulations (also referred to herein as "medicaments"). In some aspects, pharmaceutical compositions include at least one XDH RNAi agent. These pharmaceutical compositions are particularly useful in the inhibition of the expression of the target mRNA in a target cell, a group of cells, a tissue, or an organism.

The pharmaceutical compositions can be used to treat a subject having a disease, disorder, or condition that would benefit from reduction in the level of the target XDH mRNA, or inhibition in expression of the target gene. The pharmaceutical compositions can be used to treat a subject at risk of developing a disease, disorder, symptom, or condition that would benefit from reduction of the level of the target mRNA or an inhibition in expression the target gene. In one embodiment, the method includes administering an XDH RNAi agent linked to a targeting ligand as described herein, to a subject to be treated. In some aspects, one or more pharmaceutically acceptable excipients (including vehicles, carriers, diluents, and/or delivery polymers) are added to the pharmaceutical compositions that include an XDH RNAi agent, thereby forming a pharmaceutical formulation or medicament suitable for in vivo delivery to a subject, including a human.

The pharmaceutical compositions that include an XDH RNAi agent and methods disclosed herein decrease the level of the target mRNA in a cell, group of cells, group of cells, tissue, organ, or subject, including by administering to the subject a therapeutically effective amount of a herein described XDH RNAi agent, thereby inhibiting the expression of XDH mRNA in the subject. In some aspects, the subject has been previously identified as having a pathogenic upregulation of the target gene in hepatocytes. In some aspects, the subject has been previously identified or diagnosed as having gout or hyperuricemia. In some aspects, the subject has been suffering from symptoms associated with gout or hyperuricemia. In some aspects, the subject would benefit from a reduction of XDH gene expression in the subject's liver.

In some aspects, the described pharmaceutical compositions including an XDH RNAi agent are used for treating or managing clinical presentations associated with gout or hyperuricemia. In some aspects, a therapeutically (including prophylactically) effective amount of one or more of pharmaceutical compositions is administered to a subject in need of such treatment. In some aspects, administration of any of the disclosed XDH RNAi agents can be used to decrease the number, severity, and/or frequency of symptoms of a disease in a subject.

The described pharmaceutical compositions that include an XDH RNAi agent can be used to treat at least one symptom in a subject having a disease or disorder that would benefit from reduction or inhibition in expression of XDH mRNA and/or a reduction in serum uric acid levels. Measuring serum uric acid levels can be conducted in accordance with established methods known in the art.

In some aspects, the subject is administered a therapeutically effective amount of one or more pharmaceutical compositions that include an XDH RNAi agent thereby treating the symptom. In other aspects, the subject is administered a prophylactically effective amount of one or more XDH RNAi agents, thereby preventing or inhibiting the at least one symptom.

The route of administration is the path by which an XDH RNAi agent is brought into contact with the body. In general, methods of administering drugs and oligonucleotides and nucleic acids for treatment of a mammal are well known in the art and can be applied to administration of the compositions described herein. The XDH RNAi agents disclosed herein can be administered via any suitable route in a preparation appropriately tailored to the particular route. Thus, herein described pharmaceutical compositions can be administered by injection, for example, intravenously, intramuscularly, intracutaneously, subcutaneously, intraarticularly, or intraperitoneally. In some aspects, the herein described pharmaceutical compositions are administered via subcutaneous injection.

The pharmaceutical compositions including an XDH RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intramuscular, transdermal, airway (aerosol), nasal, oral, rectal, or topical (including buccal and sublingual) administration. In certain aspects, the compositions are administered by subcutaneous or intravenous infusion or injection.

In some aspects, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., XDH RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® ELTM (BASF, Parsippany, N.J.) or phosphate buffered saline (PBS). Suitable carriers should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle, which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

In some aspects, pharmaceutical formulations that include the XDH RNAi agents disclosed herein suitable for subcutaneous administration can be prepared in an aqueous sodium phosphate buffer (e.g., the XDH RNAi agent formulated in 0.5 mM sodium phosphate monobasic, 0.5 mM sodium phosphate dibasic, in water). In some aspects, pharmaceutical formulations that include the XDH RNAi agents disclosed herein suitable for subcutaneous administration can be prepared in water for injection (sterile water). XDH RNAi agents disclosed herein suitable for subcutaneous administration can be prepared in isotonic saline (0.9%).

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

Formulations suitable for oral administration of the XDH RNAi agents disclosed herein can also be prepared. In some aspects, the XDH RNAi agents disclosed herein are administered orally. In some aspects, the XDH RNAi agents disclosed herein are formulated in a capsule for oral administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The XDH RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, analgesics, antihistamines, or anti-inflammatory agents (e.g., acetaminophen, NSAIDs, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some aspects, the methods disclosed herein further comprise the step of administering a second therapeutic or treatment in addition to administering an RNAi agent disclosed herein. In some aspects, the second therapeutic is another XDH RNAi agent (e.g., an XDH RNAi agent that targets a different sequence within the XDH target). In other aspects, the second therapeutic can be a small molecule drug, an antibody, an antibody fragment, or an aptamer.

In some aspects, the described XDH RNAi agent(s) are optionally combined with one or more additional therapeutics. The XDH RNAi agent and additional therapeutic(s) can be administered in a single composition or they can be administered separately. In some aspects, the one or more additional therapeutics is administered separately in separate dosage forms from the RNAi agent (e.g., the XDH RNAi agent is administered by subcutaneous injection, while the additional therapeutic involved in the method of treatment dosing regimen is administered orally). In some aspects, the described XDH RNAi agent(s) are administered to a subject in need thereof via subcutaneous injection, and the one or more optional additional therapeutics are administered orally, which together provide for a treatment regimen for diseases and conditions associated with gout or hyperuricemia. In some aspects. the described XDH RNAi agent(s) are administered to a subject in need thereof via subcutaneous injection, and the one or more optional additional therapeutics are administered via a separate subcutaneous injection. In some aspects, the XDH RNAi agent and one or more additional therapeutics are combined into a single dosage form (e.g., a "cocktail" formulated into a single composition for subcutaneous injection). The XDH RNAi agents, with or without the one or more additional therapeutics, can be combined with one or more excipients to form pharmaceutical compositions.

Generally, an effective amount of an XDH RNAi agent will be in the range of from about 0.1 to about 100 mg/kg of body weight/dose, e.g., from about 1.0 to about 50 mg/kg of body weight/dose. In some aspects, an effective amount of an active compound will be in the range of from about 0.25 to about 5 mg/kg of body weight per dose. In some aspects, an effective amount of an active ingredient will be in the range of from about 0.5 to about 4 mg/kg of body weight per dose. In some aspects, an effective amount of an XDH RNAi agent may be a fixed dose. In some aspects, the fixed dose is in the range of from about 5 mg to about 1,000 mg of XDH RNAi agent. In some aspects, the fixed does is in the range of 50 to 400 mg of XDH RNAi agent. Dosing may be weekly, bi-weekly, monthly, quarterly, or at any other interval depending on the dose of XDH RNAi agent administered, the activity level of the particular XDH RNAi agent, and the desired level of inhibition for the particular subject. The Examples herein show suitable levels for inhibition in certain animal species. The amount administered will depend on such variables as the overall health status of the patient or subject, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum.

For treatment of disease or for formation of a medicament or composition for treatment of a disease, the pharmaceutical compositions described herein including an XDH RNAi agent can be combined with an excipient or with a second therapeutic agent or treatment including, but not limited to: a second or other RNAi agent, a small molecule drug, an antibody, an antibody fragment, peptide and/or an aptamer.

The described XDH RNAi agents, when added to pharmaceutically acceptable excipients or adjuvants, can be packaged into kits, containers. packs, or dispensers. The pharmaceutical compositions described herein may be packaged in pre-filled syringes, pen injectors, autoinjectors, infusion bags/devices, or vials.

Methods of Treatment and Inhibition of Expression

The XDH RNAi agents disclosed herein can be used to treat a subject (e.g., a human or other mammal) having a disease or disorder that would benefit from administration of the RNAi agent. In some aspects, the RNAi agents disclosed herein can be used to treat a subject (e.g., a human) that would benefit from reduction and/or inhibition in expression of XDH mRNA and/or XDH protein levels, which can lead to a reduction in serum uric acid levels in, for example, a subject that has been diagnosed with or is suffering from symptoms related to gout or hyperuricemia.

In some aspects, the subject is administered a therapeutically effective amount of any one or more XDH RNAi agents. Treatment of a subject can include therapeutic and/or prophylactic treatment. The subject is administered a therapeutically effective amount of any one or more XDH RNAi agents described herein. The subject can be a human, patient, or human patient. The subject may be an adult, adolescent, child, or infant. Administration of a pharmaceutical composition described herein can be to a human being or animal.

The XDH RNAi agents described herein can be used to treat at least one symptom in a subject having an XDH-related disease or disorder, or having a disease or disorder that is mediated at least in part by XDH gene expression. In some aspects, the XDH RNAi agents are used to treat or manage a clinical presentation of a subject with a disease or disorder that would benefit from or be mediated at least in part by a reduction in XDH mRNA. The subject is administered a therapeutically effective amount of one or more of the XDH RNAi agents or XDH RNAi agent-containing compositions described herein. In some aspects, the methods disclosed herein comprise administering a composition comprising an XDH RNAi agent described herein to a subject to be treated. In some aspects, the subject is administered a prophylactically effective amount of any one or more of the described XDH RNAi agents, thereby treating the subject by preventing or inhibiting the at least one symptom.

In certain aspects, the present disclosure provides methods for treatment of diseases, disorders, conditions, or pathological states mediated at least in part by XDH gene expression, in a patient in need thereof, wherein the methods include administering to the patient any of the XDH RNAi agents described herein.

In some aspects, the RNAi agent comprises an antisense strand comprising an unmodified nucleic acid sequence of AM15135, AM14244, AM15149, AM13882, AM14216, AM14387, AM14240, AM14238, or AM14236, and a sense strand comprising an unmodified nucleic acid sequence of AM14284, AM14243, AM14528, AM13881, AM14215, AM13877, AD14239, AD14237, or AD14235.

In some aspects, the XDH RNAi agent comprises an antisense strand comprising a modified nucleic acid sequence of AM15135, AM14244, AM15149, AM13882, AM14216, AM14387, AM14240, AM14238, or AM14236, and a sense strand comprising a modified nucleic acid sequence of AM14284, AM14243, AM14528, AM13881, AM14215, AM13877, AD14239, AD14237, or AD14235.

In some aspects, the RNAi agent comprises an antisense strand comprising a nucleic acid sequence of UUCCAUAAUACUCUGAGAGAG (SEQ ID NO:1448) and a sense strand comprising a nucleic acid sequence of CUCUCUCAGAGUAUUAUGGAA (SEQ ID NO:1603). In some aspects, a nucleic acid sequence of the antisense strand comprises a nucleic acid sequence of cPrpusUfscCfauaauacUfcUfgAfgagsasg (SEQ ID NO:1146) and a nucleic acid sequence of the sense strand comprises a nucleic acid sequence of cucucucaGfaGfuAfuuauggaa (SEQ ID NO:1663) or (invAb)scucucucaGfaGfuAfuuauggaas(invAb) (SEQ ID NO:1680).

In some aspects, the RNAi agent comprises an antisense strand comprising a nucleic acid sequence of AUGACAAUAUCUGUGCGGAGG (SEQ ID NO:1468) and a sense strand comprising a nucleic acid sequence of CCUCCGCACAGAUAUUGUCAU (SEQ ID NO:1623). In some aspects, a nucleic acid sequence of the antisense strand comprises asUfsgsAfcaauaucUfgUfgCfggagsg (SEQ ID NO:1081) and a nucleic acid sequence of the sense strand comprises a nucleic acid sequence of ccuccgcaCfAfGfauauugucau (SEQ ID NO:1664) or (invAb) sccuccgcaCfAfGfauauugucaus(invAb) (SEQ ID NO:1681).

In some aspects, the RNAi agent comprises an antisense sequence comprising a nucleic acid sequence of UGCAUAUUCACCAUUUAGGCA (SEQ ID NO:1397) and a sense strand comprising a nucleic acid sequence of UGCCUAAAUGGUGAAUAUGCA (SEQ ID NO:1551). In some aspects, a nucleic acid sequence of the antisense strand comprises cPrpusGfscauauuCfacCfaUfuUfaggscsa (SEQ ID NO:1155) and a nucleic acid sequence of the sense strand comprises ugccuaaaUfgGfuGfaauaugca (SEQ ID NO:1665) or (invAb)sugccuaaaUfgGfuGfaauaugcas(invAb) (SEQ ID NO:1682).

In some aspects, the RNAi agent comprises an antisense sequence comprising a nucleic acid sequence of AUGAAACAAACAAACCCUGGA (SEQ ID NO:1440) and a sense strand comprising a nucleic acid sequence of UCCAGGGUUUGUUUGUUUCAU (SEQ ID NO:1595). In some aspects, a nucleic acid sequence of the antisense strand comprises asUfsgsAfaAfcaaacAfaAfcCfcUfggsa (SEQ ID NO:1048) and a nucleic acid sequence of the sense strand comprises uccaggguUfUfGfuuuguuucau (SEQ ID NO:1666) or (invAb)succaggguUfUfGfuuuguuucaus (invAb) (SEQ ID NO:1683).

In some aspects, the RNAi agent comprises an antisense sequence comprising a nucleic acid sequence of AGACGAUCAUACUUGGAGAGC (SEQ ID NO:1454) and a sense strand comprising a nucleic acid sequence of GCUCUCCAAGUAUGAUCIUCU (SEQ ID NO:1609). In some aspects, a nucleic acid sequence of the antisense strand comprises asGfsasCfgaucauaCfuUfgGfagagsc (SEQ ID NO:1067) and a nucleic acid sequence of the sense strand comprises gcucuccaAfGfUfaugauciucu (SEQ ID NO:1667) or (invAb)sgcucuccaAfGfUfaugauciucus(invAb) (SEQ ID NO:1684).

In some aspects, the RNAi agent comprises an antisense sequence comprising a nucleic acid sequence of UUUGAAUGCUGAGAAAUACUC (SEQ ID NO:1438) and a sense strand comprising a nucleic acid sequence of GAGUAUUUCUCAGCAUUCAAA (SEQ ID NO:1593). In some aspects, a nucleic acid sequence of the antisense strand comprises cPrpuUfuGfaaugcugAfgAfaAfuacusc (SEQ ID NO:1111) and a nucleic acid sequence of the sense strand comprises gaguauuuCfUfCfagcauucaaa (SEQ ID NO:1668) or (invAb)sgaguauuuCfUfCfagcauucaaas(invAb) (SEQ ID NO:1685).

In some aspects, the RNAi agent comprises an antisense sequence comprising a nucleic acid sequence of UUUC-CAACAAUUCUCCUUGUC (SEQ ID NO:1466) and a sense strand comprising a nucleic acid sequence of GACAAGGAGAAUUGUUGGAAA (SEQ ID NO:1621). In some aspects, a nucleic acid sequence of the antisense strand comprises usUfsusCfcaacaauUfcUfcCfuugusc (SEQ ID NO:1079) and a nucleic acid sequence of the sense strand comprises gacaaggaGfAfAfuuguuggaaa (SEQ ID NO:1669) or (invAb)sgacaaggaGfAfAfuuguuggaaas(invAb) (SEQ ID NO:1686).

In some aspects, the RNAi agent comprises an antisense sequence comprising a nucleic acid sequence of UUGU-CAACCUCACUCUUCCGA (SEQ ID NO:1465) and a sense strand comprising a nucleic acid sequence of UCG-GAAGAGUGAGGUUGACAA (SEQ ID NO:1620). In some aspects, a nucleic acid sequence of the antisense strand comprises usUfsgsUfcaaccucAfcUfcUfuccgsa (SEQ ID NO:1078) and a nucleic acid sequence of the sense strand comprises ucggaagaGfUfGfagguugacaa (SEQ ID NO:1670) or (invAb)sucggaagaGfUfGfagguugacaas(invAb) (SEQ ID NO:1687).

In some aspects, the RNAi agent comprises an antisense sequence comprising a nucleic acid sequence of UCAUGAUACUGAGAGCUUGCU (SEQ ID NO:1464) and a sense strand comprising a nucleic acid sequence of AGCAAGCUCUCAGUAUCAUGA (SEQ ID NO:1619). In some aspects, a nucleic acid sequence of the antisense strand comprises usCfsasUfgauacugAfgAfgCfuugcsu (SEQ ID NO:1077) and a nucleic acid sequence of the sense strand comprises agcaagcuCfUfCfaguaucauga (SEQ ID NO:1671) or (invAb)sagcaagcuCfUfCfaguaucaugas(invAb) (SEQ ID NO:1688).

In some aspects, the 5' end of the sense strand is coupled to a targeting ligand comprising the structure of (NAG37)s.

In some aspects, the gene expression level and/or mRNA level of an XDH gene in a subject to whom a described XDH RNAi agent is administered is reduced by at least about 30%, 35%, 40%, 45%, 50%, 55%, 60%, 65%, 70%, 75%, 80%, 85%, 95%, 96%, 97%, 98%, 99%, or greater than 99% relative to the subject prior to being administered the XDH RNAi agent or to a subject not receiving the XDH RNAi agent. The gene expression level and/or mRNA level in the subject may be reduced in a cell, group of cells, and/or tissue of the subject. In some aspects, the XDH gene expression is inhibited by at least about 30%, 35%, 40%, 45% 50%, 55%, 60%, 65%, or greater than 65% in the cytoplasm of hepatocytes relative to the subject prior to being administered the XDH RNAi agent or to a subject not receiving the XDH RNAi agent.

In some aspects, the XDH protein expression level in a subject to whom a described XDH RNAi agent has been administered is reduced by at least about 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the XDH RNAi agent or to a subject not receiving the XDH RNAi agent. The protein expression level in the subject may be reduced in a cell, group of cells, tissue, blood, and/or other fluid of the subject.

A reduction in XDH mRNA expression levels and XDH protein expression levels can be assessed by any methods known in the art. As used herein, a reduction or decrease in XDH mRNA level and/or protein level are collectively referred to herein as a reduction or decrease in XDH or inhibiting or reducing the gene expression of XDH. The Examples set forth herein illustrate known methods for assessing inhibition of XDH gene expression. The person of ordinary skill in the art would further know suitable methods for assessing inhibition of XDH gene expression in vivo and/or in vitro.

In some aspects, disclosed herein are methods of treatment (including prophylactic or preventative treatment) of diseases, disorders, or symptoms caused by caused by gout and/or hyperuricemia, wherein the methods include administering to a subject in need thereof a therapeutically effective amount of an XDH RNAi agent that includes an antisense strand that is at least partially complementary to the portion of the XDH mRNA having the sequence in Table 1. In some aspects, disclosed herein are methods of treatment (including prophylactic or preventative treatment) of diseases or symptoms caused by caused by gout or hyperuricemia, wherein the methods include administering to a subject in need thereof a therapeutically effective amount of an XDH RNAi agent that includes an antisense strand comprising the sequence of any of the sequences in Tables 2, 3 or 5C, and a sense strand that comprises any of the sequences in Tables 2, 4, or 5C that is at least partially complementary to the antisense strand. In some aspects, disclosed herein are methods of treatment (including prophylactic or preventative treatment) of diseases or symptoms caused by gout or hyperuricemia, wherein the methods include administering to a subject in need thereof a therapeutically effective amount of an XDH RNAi agent that includes a sense strand that comprises any of the sequences in Tables 2, 4, or 5C, and an antisense strand comprising the sequence of any of the sequences in Tables 2, 3, or 5C that is at least partially complementary to the sense strand.

In some aspects, the RNAi agent comprises an antisense strand comprising an unmodified nucleic acid sequence of AM15135, AM14244, AM15149, AM13882, AM14216, AM14387, AM14240, AM14238, or AM14236, and a sense strand comprising an unmodified nucleic acid sequence of AM14284, AM14243, AM14528, AM13881, AM14215, AM13877, AD14239, AD14237, or AD14235.

In some aspects, The RNAi agent comprises an antisense strand comprising a modified nucleic acid sequence of AM15135, AM14244, AM15149, AM13882, AM14216, AM14387, AM14240, AM14238, or AM14236, and a sense strand comprising a modified nucleic acid sequence of AM14284, AM14243, AM14528, AM13881, AM14215, AM13877, AD14239, AD14237, or AD14235.

In some aspects, the RNAi agent comprises an antisense strand comprising a nucleic acid sequence of UUCCAUAAUACUCUGAGAGAG (SEQ ID NO:1448) and a sense strand comprising a nucleic acid sequence of CUCUCUCAGAGUAUUAUGGAA (SEQ ID NO:1603). In some aspects, a nucleic acid sequence of the antisense strand comprises cPrpusUfscCfauaauacUfcUfgAfgagsasg (SEQ ID NO:1146) and a nucleic acid sequence of the sense strand comprises cucucucaGfaGfuAfuuauggaa (SEQ ID NO:1663) or (invAb)scucucucaGfaGfuAfuuauggaas(invAb) (SEQ ID NO: 1680).

In some aspects, the RNAi agent comprises an antisense strand comprising a nucleic acid sequence of AUGACAAUAUCUGUGCGGAGG (SEQ ID NO:1468) and a sense strand comprising a nucleic acid sequence of CCUCCGCACAGAUAUUGUCAU (SEQ ID NO:1623). In some aspects, a nucleic acid sequence of the antisense strand comprises asUfsgsAfcaauaucUfgUfgCfggagsg (SEQ ID NO:1081) and a nucleic acid sequence of the sense strand comprises ccuccgcaCfAfGfauauugucau (SEQ ID NO:1664) or (invAb)sccuccgcaCfAfGfauauugucaus(invAb) (SEQ ID NO:1681).

In some aspects, the RNAi agent comprises an antisense sequence comprising a nucleic acid sequence of UGCAUAUUCACCAUUUAGGCA (SEQ ID NO:1397) and a sense strand comprising a nucleic acid sequence of UGCCUAAAUGGUGAAUAUGCA (SEQ ID NO:1551). In some aspects, a nucleic acid sequence of the antisense strand comprises cPrpusGfscauauuCfacCfaUfuUfaggscsa (SEQ ID NO:1155) and a nucleic acid sequence of the sense strand comprises ugccuaaaUfgGfuGfaauaugca (SEQ ID NO:1665) or (invAb)sugccuaaaUfgGfuGfaauaugcas(invAb) (SEQ ID NO:1682).

In some aspects, the RNAi agent comprises an antisense sequence comprising a nucleic acid sequence of AUGAAACAAACAAACCCUGGA (SEQ ID NO:1440) and a sense strand comprising a nucleic acid sequence of UCCAGGGUUUGUUUGUUUCAU (SEQ ID NO:1595). In some aspects, a nucleic acid sequence of the antisense strand comprises asUfsgsAfaAfcaaacAfaAfcCfcUfggsa (SEQ ID NO:1048) and a nucleic acid sequence of the sense strand comprises uccaggguUfUfGfuuuguuucau (SEQ ID NO:1666) or (invAb)succaggguUfUfGfuuuguuucaus (invAb) (SEQ ID NO:1683).

In some aspects, the RNAi agent comprises an antisense sequence comprising a nucleic acid sequence of AGACGAUCAUACUUGGAGAGC (SEQ ID NO:1454) and a sense strand comprising a nucleic acid sequence of GCUCUCCAAGUAUGAUCIUCU (SEQ ID NO:1609). In some aspects, a nucleic acid sequence of the antisense strand comprises asGfsasCfgaucauaCfuUfgGfagagsc (SEQ ID NO:1067) and a nucleic acid sequence of the sense strand comprises asGfsasCfgaucauaCfuUfgGfagagsc (SEQ ID NO:1067) and a nucleic acid sequence of the sense strand comprises gcucuccaAfGfUfaugauciucu (SEQ ID NO:1667) or (invAb)sgcucuccaAfGfUfaugauciucus(invAb) (SEQ ID NO:1684).

In some aspects, the RNAi agent comprises an antisense sequence comprising a nucleic acid sequence of UUUGAAUGCUGAGAAAUACUC (SEQ ID NO:1438) and a sense strand comprising a nucleic acid sequence of GAGUAUUUCUCAGCAUUCAAA (SEQ ID NO:1593). In some aspects, a nucleic acid sequence of the antisense strand comprises cPrpuUfuGfaaugcugAfgAfaAfuacusc (SEQ ID NO:1111) and a nucleic acid sequence of the sense strand comprises gaguauuuCfUfCfagcauucaaa (SEQ ID NO:1668) or (invAb)sgaguauuuCfUfCfagcauucaaas(invAb) (SEQ ID NO:1685).

In some aspects, the RNAi agent comprises an antisense sequence comprising a nucleic acid sequence of UUUCCAACAAUUCUCCUUGUC (SEQ ID NO:1466) and a sense strand comprising a nucleic acid sequence of GACAAGGAGAAUUGUUGGAAA (SEQ ID NO:1621). In some aspects, a nucleic acid sequence of the antisense strand comprises usUfsusCfcaacaauUfcUfcCfuugusc (SEQ ID NO:1079) and a nucleic acid sequence of the sense strand comprises gacaaggaGfAfAfuuguuggaaa (SEQ ID NO:1669) or (invAb)sgacaaggaGfAfAfuuguuggaaas(invAb) (SEQ ID NO:1686).

In some aspects, the RNAi agent comprises an antisense sequence comprising a nucleic acid sequence of UUGUCAACCUCACUCUUCCGA (SEQ ID NO:1465) and a sense strand comprising a nucleic acid sequence of UCGGAAGAGUGAGGUUGACAA (SEQ ID NO:1620). In some aspects, a nucleic acid sequence of the antisense strand comprises usUfsgsUfcaaccucAfcUfcUfuccgsa (SEQ ID NO:1078) and a nucleic acid sequence of the sense strand comprises ucggaagaGfUfGfagguugacaa (SEQ ID NO:1670) or (invAb)sucggaagaGfUfGfagguugacaas(invAb) (SEQ ID NO:1687).

In some aspects, the RNAi agent comprises an antisense sequence comprising a nucleic acid sequence of UCAUGAUACUGAGAGCUUGCU (SEQ ID NO:1464) and a sense strand comprising a nucleic acid sequence of AGCAAGCUCUCAGUAUCAUGA (SEQ ID NO:1619). In some aspects, a nucleic acid sequence of the antisense strand comprises usCfsasUfgauacugAfgAfgCfuugcsu (SEQ ID NO:1077) and a nucleic acid sequence of the sense strand comprises agcaagcuCfUfCfaguaucauga (SEQ ID NO:1671) or (invAb)sagcaagcuCfUfCfaguaucaugas(invAb) (SEQ ID NO:1688).

In some aspects, the 5' end of the sense strand is coupled to a targeting ligand comprising the structure of (NAG37)s.

In some aspects, disclosed herein are methods for inhibiting expression of an XDH gene in a cell, wherein the methods include administering to the cell an XDH RNAi agent that includes an antisense strand that is at least partially complementary to the portion of the XDH mRNA having the sequence in Table 1. In some aspects, disclosed herein are methods of inhibiting expression of an XDH gene in a cell, wherein the methods include administering to a cell an XDH RNAi agent that includes an antisense strand comprising the sequence of any of the sequences in Tables 2, 3, or 5C and a sense strand that comprises any of the sequences in Tables 2, 4, or 5C that is at least partially complementary to the antisense strand. In some aspects, disclosed herein are methods of inhibiting expression of an XDH gene in a cell, wherein the methods include administering an XDH RNAi agent that includes a sense strand that comprises any of the sequences in Tables 2, 4, or 5C, and an antisense strand that includes the sequence of any of the sequences in Tables 2, 3, or 5C that is at least partially complementary to the sense strand.

In some aspects, the XDH RNAi agents are administered to a subject in need thereof as a first line therapy. In some aspects, the XDH RNAi agents are administered to a subject in need thereof as a second line therapy. In certain aspects, the XDH RNAi agents are administered as a second line therapy to patients who have failed one or more first line standard of care therapies. In certain aspects, the XDH RNAi agents are administered as a maintenance therapy following the administration of one or more prior therapies. In certain aspects, the XDH RNAi agents administered as a maintenance therapy following the administration of one or more standard of care therapies. In some aspects, the XDH RNAi agents administered in combination with one or more additional therapies. In some aspects, the one or more additional therapies is a standard of care therapy. In some aspects, the one or more additional therapies is an oral therapy.

Provided herein are methods for treating gout using the XDH RNAi agents described herein, for example, RNAi agent comprising an antisense strand comprising an unmodified nucleic acid sequence of AM15135, AM14244, AM15149, AM13882, AM14216, AM14387, AM14240, AM14238, or AM14236, and a sense strand comprising an unmodified nucleic acid sequence of AM14284, AM14243, AM14528, AM13881, AM14215, AM13877, AD14239, AD14237, or AD14235. In some aspects, the gout is uncontrolled gout. In some aspects, the oligonucleotide, composition, or pharmaceutical composition described herein is administered as a second line therapy to patients who have failed allopurinol and/or febuxostat. In some aspects, the oligonucleotide, composition, or pharmaceutical composition described herein is administered prior to KRYSTEXXA. In some aspects, the oligonucleotide, composition, or pharmaceutical composition described herein is administered as a maintenance therapy following the administration of KRYSTEXXA.

The use of XDH RNAi agents provides methods for therapeutic (including prophylactic) treatment of diseases/disorders associated with gout, hyperuricemia, elevated serum uric acid levels, or elevated XDH gene expression. The described XDH RNAi agents mediate RNA interference to inhibit the expression of one or more genes necessary for production of XDH protein. XDH RNAi agents can also be used to treat or prevent various diseases, disorders, or conditions, including gout. Furthermore, compositions for delivery of XDH RNAi agents to liver cells, and specifically to hepatocytes, in vivo, are described.

Cells, Tissues, Organs, and Non-Human Organisms

Cells, tissues, organs, and non-human organisms that include at least one of the XDH RNAi agents described herein are contemplated. The cell, tissue, organ, or non-human organism is made by delivering the RNAi agent to the cell, tissue, organ or non-human organism.

Illustrative Embodiments

Provided here are illustrative embodiments of the disclosed technology. These embodiments are illustrative only and do not limit the scope of the present disclosure or of the claims attached hereto.

Embodiment 1. An RNAi agent for inhibiting expression of an XDH gene, comprising:

an antisense strand comprising at least 15 contiguous nucleotides differing by 0, 1, 2, or 3, nucleotides from any one of the sequences antisense strand sequences disclosed in Table 2, Table 3, or Table 5C; and a sense strand comprising a nucleotide sequence that is at least partially complementary to the antisense strand.

Embodiment 2. An RNAi agent for inhibiting expression of an XDH gene, comprising:

a sense strand comprising at least 15 contiguous nucleotides differing by 0, 1, 2, or 3 nucleotides from a stretch of the same length of nucleotides of SEQ ID NO:1; and an antisense strand comprising a nucleotide sequences that is at least partially complementary to the sense strand.

Embodiment 3. The RNAi agent of embodiment 1, wherein the antisense strand comprises nucleotides at positions 2-18 of any one of the antisense strand sequences of Table 2, Table 3, or Table 5C.

Embodiment 4. The RNAi agent of embodiment 1 or embodiment 2, wherein the sense strand comprises a nucleotide sequence of at least 15 contiguous nucleotides differing by 0 or 1 nucleotide from any one of the sense strand sequences of Table 2, Table 4, or Table 5C, and wherein the sense strand has a region of at least 85% complementarily over the 15 contiguous nucleotides to the antisense strand.

Embodiment 5. The RNAi agent of any one of embodiments 1-4, wherein at least one nucleotide of the RNAi agent is a modified nucleotide or includes a modified internucleoside linkage.

Embodiment 6. The RNAi agent of any one of aspects 1-5, wherein all or substantially all of the nucleotides of the sense and/or antisense strand of the RNAi agent are modified nucleotides.

Embodiment 7. The RNAi agent of any one of aspects 5-6, wherein the modified nucleotide is selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholino nucleotide, vinyl phosphonate containing nucleotide, cyclopropyl phosphonate containing nucleotide, and 3'—O-methyl nucleotide.

Embodiment 8. The RNAi agent of embodiment 7, wherein all or substantially all of the modified nucleotides are 2'-O-methyl nucleotides, 2'-fluoro nucleotides, or combinations thereof.

Embodiment 9. The RNAi agent of any one of aspects 1-8, wherein the antisense strand comprises the nucleotide sequence of any one of the modified antisense strand sequences of Table 3 or Table 5C.

Embodiment 10. The RNAi agent of any one of aspects 1-9, wherein the sense strand comprises the nucleotide sequence of any of the modified sense strand sequences of Table 4 or Table 5C.

Embodiment 11. The RNAi agent of embodiment 1, wherein the antisense strand comprises the nucleotide sequence of any one of the modified sequences of Table 5C and the sense strand comprises the nucleotide sequence of any one of the modified sequences of Table 5C.

Embodiment 12. The RNAi agent of any one of aspects 1-11, wherein the RNAi agent is linked to a targeting ligand.

Embodiment 13. The RNAi agent of embodiment 12, wherein the targeting ligand comprises n-acetyl-galactosamine.

Embodiment 14. The RNAi agent of embodiment 12 or 13, wherein the targeting ligand comprises the structure of (NAG37) or (NAG37)s.

Embodiment 15. The RNAi agent of any one of aspects 11-14, wherein the targeting ligand is linked to the sense strand.

Embodiment 16. The RNAi agent of embodiment 15, wherein the targeting ligand is linked to the 5' terminal end of the sense strand.

Embodiment 17. The RNAi agent of any one of aspects 1-16, wherein the sense strand is between 15 and 30 nucleotides in length, and the antisense strand is between 18 and 30 nucleotides in length.

Embodiment 18. The RNAi agent of embodiment 17, wherein the sense strand and the antisense strand are each between 18 and 27 nucleotides in length.

Embodiment 19. The RNAi agent of embodiment 18, wherein the sense strand and the antisense strand are each between 18 and 24 nucleotides in length.

Embodiment 20. The RNAi agent of embodiment 19, wherein the sense strand and the antisense strand are each 21 nucleotides in length.

Embodiment 21. The RNAi agent of any one of aspects 17-20, wherein the RNAi agent has two blunt ends.

Embodiment 22. The RNAi agent of any one of aspects 1-21, wherein the sense strand comprises one or two terminal caps.

Embodiment 23. The RNAi agent of any one of aspects 1-22, wherein the sense strand comprises one or two inverted abasic residues.

Embodiment 24. The RNAi agent of embodiment 1, wherein the RNAi agent is comprised of a sense strand and an antisense strand that form a duplex sequence of any one of the duplexes as listed in Table 5A, Table 5B, or Table 5C.

Embodiment 25. The RNAi agent of any one of aspects 1-23, wherein the sense strand further includes inverted abasic residues at the 3' terminal end of the nucleotide sequence, at the 5' end of the nucleotide sequence, or at both.

Embodiment 26. The RNAi agent of embodiment 1, comprising an antisense strand that comprises, consists of, or consists essentially of a modified nucleotide sequence that differs by 0 or 1 nucleotide from one of the antisense strand nucleotide sequences of Table 3 or Table 5C, wherein a, c, g, and u represent 2'-O-methyl adenosine, cytidine, guanosine, and uridine, respectively; Af, Cf, Gf, and Uf represent 2'-fluoro adenosine, cytidine, guanosine, and uridine, respectively; cPrpa and cPrpu represent 5'-cyclopropyl phosphonate-2'-O-methyl adenosine and 5'-cyclopropyl phosphonate-2'-O-methyl uridine, respectively; CUNA and UUNA represent 2',3'-seco-cytidine and 2',3'-seco-uridine, respectively; s represents a phosphorothioate linkage; and wherein all or substantially all of the nucleotides on the sense strand are modified nucleotides.

Embodiment 27. The RNAi agent of embodiment 1, wherein the sense strand comprises, consists of, or consists essentially of a modified nucleotide sequence that differs by 0 or 1 nucleotide from one of the nucleotide sequences of Table 4 or Table 5C, wherein a, c, g, i, and u represent 2'-O-methyl adenosine, cytidine, guanosine, inosine, and uridine, respectively; Af, Cf, Gf, and Uf represent 2'-fluoro adenosine, cytidine, guanosine, and uridine, respectively; a_2N represents 2'-O-methyl-2-aminoadenosine; s represents a phosphorothioate linkage; and wherein all or substantially all of the nucleotides on the antisense strand are modified nucleotides.

Embodiment 28. The RNAi agent of any one of aspects 24-27, wherein the sense strand includes inverted abasic residues at the 3' terminal end of the nucleotide sequence, at the 5' end of the nucleotide sequence, or at both.

Embodiment 29. The RNAi agent of any one of aspects 24-28, wherein the sense strand of the RNAi agent is linked to a targeting ligand.

Embodiment 30. The RNAi agent of embodiment 29, wherein the targeting ligand has affinity for the asialoglycoprotein receptor.

Embodiment 31. The RNAi agent of embodiment 30, wherein the targeting ligand comprises N-acetyl-galactosamine.

Embodiment 32. The RNAi agent of embodiment 1, wherein the targeting ligand comprises:

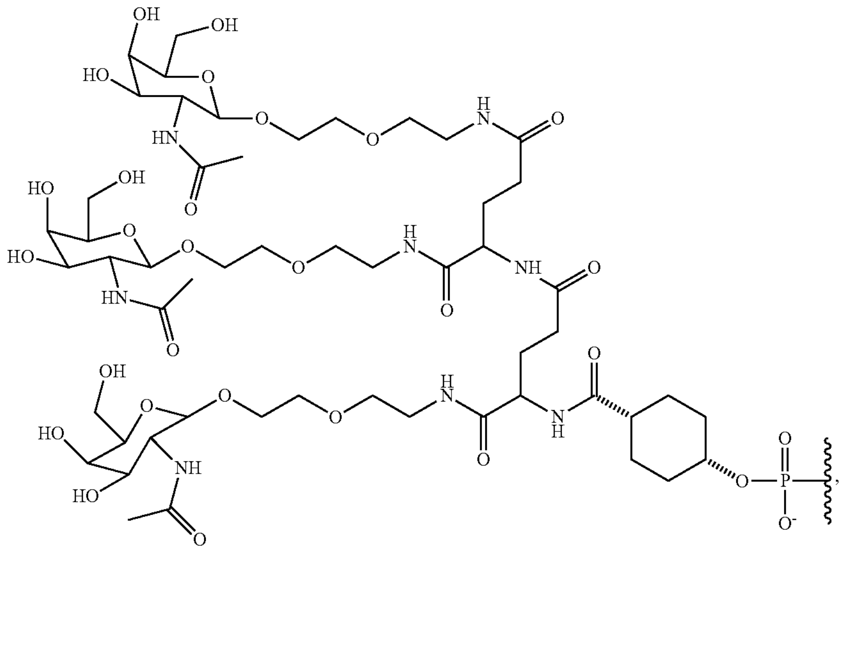

, or

-continued

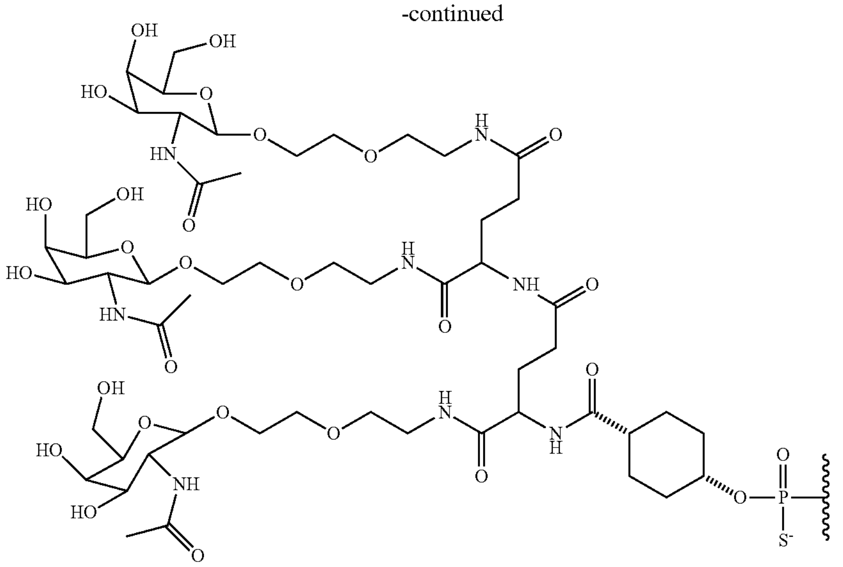

Embodiment 33. The RNAi agent of embodiment 1, wherein the antisense strand consists of a modified nucleotide sequence of Table 3 or Table 5C and the sense strand consists of a modified nucleotide sequence of Table 4 or Table 5C, wherein a, c, g, i, and u represent 2'-O-methyl adenosine, cytidine, guanosine, inosine, and uridine, respectively; Af, Cf, Gf, and Uf represent 2'-fluoro adenosine, cytidine, guanosine, and uridine, respectively; cPrpa and cPrpu represent 5'-cyclopropyl phosphonate-2'-O-methyl adenosine and 5'-cyclopropyl phosphonate-2'-O-methyl uridine, respectively; a_2N represents 2'-O-methyl-2-aminoadenosine; CUNA and UUNA represent 2',3'-seco-cytidine and 2',3'-seco-uridine, respectively; s represents a phosphorothioate linkage; (invAb) represents an inverted abasic deoxyribose residue; and (NAG37)s has the following chemical structure:

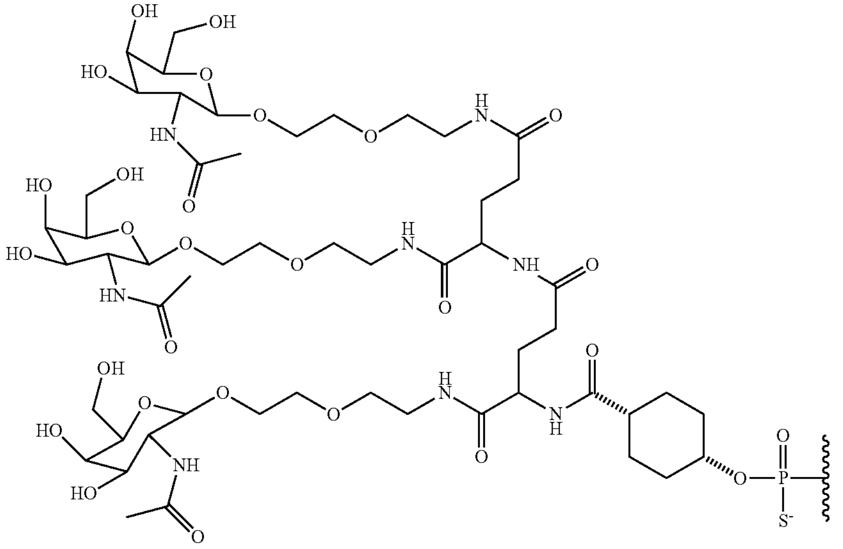

Embodiment 34. The RNAi agent of any one of embodiments 1-3, wherein a nucleic acid sequence of the antisense strand comprises an unmodified nucleic acid sequence of AM15135, AM14244, AM15149, AM13882, AM14216, AM14387, AM14240, AM14238, or AM14236, and a nucleic acid sequence of the sense strand comprises an unmodified nucleic acid sequence of AM14284, AM14243, AM14528, AM13881, AM14215, AM13877, AD14239, AD14237, or AD14235.

Embodiment 35. The RNAi agent of any one of embodiments 1-3, wherein a nucleic acid sequence of the antisense strand comprises a modified nucleic acid sequence of AM15135, AM14244, AM15149, AM13882, AM14216, AM14387, AM14240, AM14238, or AM14236, and a nucleic acid sequence of the sense strand comprises a modified nucleic acid sequence of AM14284, AM14243, AM14528, AM13881, AM14215, AM13877, AD14239, AD14237, or AD14235.

Embodiment 36. The RNAi agent of any one of embodiments 1-3, wherein a nucleic acid sequence of the antisense strand comprises UUCCAUAAUACUCUGAGAGAG (SEQ ID NO:1448) and a nucleic acid sequence of the sense strand comprises CUCUCUCAGAGUAUUAUGGAA (SEQ ID NO:1603).

Embodiment 37. The RNAi agent of any one of embodiments 1-3, wherein a nucleic acid sequence of the antisense strand comprises cPrpusUfscCfauaauacUfcUfgAfgagsasg (SEQ ID NO:1146) and a nucleic acid sequence of the sense strand comprises cucucucaGfaGfuAfuuauggaa (SEQ ID NO:1663), wherein lower case (n)=2'-O-Me; Nf=2'-F; cPrpn=5'-cyclopropyl phosphonate-2'-O-methyl; (and s=phosphorothioate backbone modification.

Embodiment 38. The RNAi agent of any one of embodiments 1-3, wherein a nucleic acid sequence of the antisense strand comprises cPrpusUfscCfauaauacUfcUfgAfgagsasg (SEQ ID NO:1146) and the sense strand comprises (invAb) scucucucaGfaGfuAfuuauggaas(invAb) (SEQ ID NO:1680) wherein lower case (n)=2'-O-Me; Nf=2'-F; cPrpn=5'-cyclopropyl phosphonate-2'-O-methyl; (invAb)=inverted abasic residue; and s=phosphorothioate backbone modification.

Embodiment 39. The RNAi agent of any one of embodiments 1-3, wherein a nucleic acid sequence of the antisense strand comprises AUGACAAUAUCUGUGCGGAGG (SEQ ID NO:1468) and a nucleic acid sequence of the sense strand comprises CCUCCGCACAGAUAUUGUCAU (SEQ ID NO:1623).

Embodiment 40. The RNAi agent of any one of embodiments 1-3, wherein a nucleic acid sequence of the antisense strand comprises asUfsgsAfcaauaucUfgUfgCfggagsg (SEQ ID NO:1081) and a nucleic acid sequence of the sense strand comprises ccuccgcaCfAfGfauauugucau (SEQ ID NO:1664), wherein lower case (n)=2'-O-Me; Nf=2'-F; and s=phosphorothioate backbone modification.

Embodiment 41. The RNAi agent of any one of embodiments 1-3, wherein a nucleic acid sequence of the antisense strand comprises asUfsgsAfcaauaucUfgUfgCfggagsg (SEQ ID NO:1081) and the sense strand comprises (invAb)sccuccgcaCfAfGfauauugucaus(invAb) (SEQ ID NO:1681) wherein lower case (n)=2'-O-Me; Nf=2'-F; (invAb)=inverted abasic residue; and s=phosphorothioate backbone modification.

Embodiment 42. The RNAi agent of any one of embodiments 1-3, wherein a nucleic acid sequence of the antisense strand comprises UGCAUAUUCACCAUUUAGGCA (SEQ ID NO:1397) and a nucleic acid sequence of the sense strand comprises UGCCUAAAUGGUGAAUAUGCA (SEQ ID NO:1551).

Embodiment 43. The RNAi agent of any one of embodiments 1-3, wherein a nucleic acid sequence of the antisense strand comprises cPrpusGfscauauuCfacCfaUfuUfaggscsa (SEQ ID NO:1155) and a nucleic acid sequence of the sense strand comprises ugccuaaaUfgGfuGfaauaugca (SEQ ID NO:1665), wherein lower case (n)=2'-O-Me; Nf=2'-F; and s=phosphorothioate backbone modification.

Embodiment 44. The RNAi agent of any one of embodiments 1-3, wherein a nucleic acid sequence of the antisense strand comprises cPrpusGfscauauuCfacCfaUfuUfaggscsa (SEQ ID NO:1155) and the sense strand comprises (invAb) sugccuaaaUfgGfuGfaauaugcas(invAb) (SEQ ID NO:1682), wherein lower case (n)=2'-O-Me; Nf=2'-F; (invAb)=inverted abasic residue; and s=phosphorothioate backbone modification.

Embodiment 45. The RNAi agent of any one of embodiments 1-3, wherein a nucleic acid sequence of the antisense strand comprises AUGAAACAAACAAACCCUGGA (SEQ ID NO:1440) and a nucleic acid sequence of the sense strand comprises UCCAGGGUUUGUUUGUUUCAU (SEQ ID NO:1595).

Embodiment 46. The RNAi agent of any one of embodiments 1-3, wherein a nucleic acid sequence of the antisense strand comprises asUfsgsAfaAfcaaacAfaAfcCfcUfggsa (SEQ ID NO:1048) and a nucleic acid sequence of the sense strand comprises uccaggguUfUfGfuuuguuucau (SEQ ID NO:1666), wherein lower case (n)=2'-O-Me; Nf=2'-F; and s=phosphorothioate backbone modification.

Embodiment 47. The RNAi agent of any one of embodiments 1-3, wherein a nucleic acid sequence of the antisense strand comprises asUfsgsAfaAfcaaacAfaAfcCfcUfggsa (SEQ ID NO:1048) and the sense strand comprises (invAb) succaggguUfUfGfuuuguuucaus(invAb) (SEQ ID NO:1683), wherein lower case (n)=2'-O-Me; Nf=2'-F; (invAb)=inverted abasic residue; and s=phosphorothioate backbone modification.

Embodiment 48. The RNAi agent of any one of embodiments 1-3, wherein a nucleic acid sequence of the antisense strand comprises AGACGAUCAUACUUGGAGAGC (SEQ ID NO:1454) and a nucleic acid sequence of the sense strand comprises GCUCUCCAAGUAUGAUCIUCU (SEQ ID NO:1609).

Embodiment 49. The RNAi agent of any one of embodiments 1-3, wherein a nucleic acid sequence of the antisense strand comprises asGfsasCfgaucauaCfuUfgGfagagsc (SEQ ID NO:1067) and a nucleic acid sequence of the sense strand comprises gcucuccaAfGfUfaugauciucu (SEQ ID NO:1667), wherein lower case (n)=2'-O-Me; Nf=2'-F; and s=phosphorothioate backbone modification.

Embodiment 50. The RNAi agent of any one of embodiments 1-3, wherein a nucleic acid sequence of the antisense strand comprises asGfsasCfgaucauaCfuUfgGfagagsc (SEQ ID NO:1067) and the sense strand comprises (invAb)sgcucuccaAfGfUfaugauciucus(invAb) (SEQ ID NO:1684), wherein lower case (n)=2'-O-Me; Nf=2'-F; (invAb)=inverted abasic residue; and s=phosphorothioate backbone modification.

Embodiment 51. The RNAi agent of any one of embodiments 1-3, wherein a nucleic acid sequence of the antisense strand comprises UUUGAAUGCUGAGAAAUACUC (SEQ ID NO:1438) and a nucleic acid sequence of the sense strand comprises GAGUAUUUCUCAGCAUUCAAA (SEQ ID NO:1593).

Embodiment 52. The RNAi agent of any one of embodiments 1-3, wherein a nucleic acid sequence of the antisense strand comprises cPrpuUfuGfaaugcugAfgAfaAfuacusc (SEQ ID NO:1111) and a nucleic acid sequence of the sense strand comprises gaguauuuCfUfCfagcauucaaa (SEQ ID NO:1668), wherein lower case (n)=2'-O-Me; Nf=2'-F; cPrpn=5'-cyclopropyl phosphonate-2'-O-methyl; and s=phosphorothioate backbone modification.

Embodiment 53. The RNAi agent of any one of embodiments 1-3, wherein a nucleic acid sequence of the antisense strand comprises cPrpuUfuGfaaugcugAfgAfaAfuacusc (SEQ ID NO:1111) and the sense strand comprises (invAb) sgaguauuuCfUfCfagcauucaaas(invAb) (SEQ ID NO:1685), wherein lower case (n)=2'-O-Me; Nf=2'-F; cPrpn=5'-cyclopropyl phosphonate-2'-O-methyl; (invAb)=inverted abasic residue; and s=phosphorothioate backbone modification.

Embodiment 54. The RNAi agent of any one of embodiments 1-3, wherein a nucleic acid sequence of the antisense strand comprises UUUCCAACAAUUCUCCUUGUC (SEQ ID NO:1466) and a nucleic acid sequence of the sense strand comprises GACAAGGAGAAUUGUUGGAAA (SEQ ID NO:1621).

Embodiment 55. The RNAi agent of any one of embodiments 1-3, wherein a nucleic acid sequence of the antisense strand comprises usUfsusCfcaacaauUfcUfcCfuugusc (SEQ ID NO:1079) and a nucleic acid sequence of the sense strand comprises gacaaggaGfAfAfuuguuggaaa (SEQ ID NO:1669), wherein lower case (n)=2'-O-Me; Nf=2'-F; and s=phosphorothioate backbone modification.

Embodiment 56. The RNAi agent of any one of embodiments 1-3, wherein a nucleic acid sequence of the antisense strand comprises usUfsusCfcaacaauUfcUfcCfuugusc (SEQ ID NO:1079) and the sense strand comprises (invAb) sgacaaggaGfAfAfuuguuggaaas(invAb) (SEQ ID NO:1686), wherein lower case (n)=2'-O-Me; Nf=2'-F; (invAb)=inverted abasic residue; and s=phosphorothioate backbone modification.

Embodiment 57. The RNAi agent of any one of embodiments 1-3, wherein a nucleic acid sequence of the antisense strand comprises UUGUCAACCUCACUCUUCCGA (SEQ ID NO:1465) and a nucleic acid sequence of the sense strand comprises UCGGAAGAGUGAGGUUGACAA (SEQ ID NO:1620).

Embodiment 58. The RNAi agent of any one of embodiments 1-3, wherein a nucleic acid sequence of the antisense strand comprises usUfsgsUfcaaccucAfcUfcUfuccgsa (SEQ ID NO:1078) and a nucleic acid sequence of the sense strand comprises ucggaagaGfUfGfagguugacaa (SEQ ID NO:1670), wherein lower case (n)=2'-O-Me; Nf=2'-F; and s=phosphorothioate backbone modification.

Embodiment 59. The RNAi agent of any one of embodiments 1-3, wherein a nucleic acid sequence of the antisense strand comprises usUfsgsUfcaaccucAfcUfcUfuccgsa (SEQ ID NO:1078) and the sense strand comprises (invAb)sucggaagaGfUfGfagguugacaas(invAb) (SEQ ID NO:1687), wherein lower case (n)=2'-O-Me; Nf=2'-F; (invAb)=inverted abasic residue; and s=phosphorothioate backbone modification.

Embodiment 60. The RNAi agent of any one of embodiments 1-3, wherein a nucleic acid sequence of the antisense strand comprises UCAUGAUACUGAGAGCUUGCU (SEQ ID NO:1464) and a nucleic acid sequence of the sense strand comprises AGCAAGCUCUCAGUAUCAUGA (SEQ ID NO:1619).

Embodiment 61. The RNAi agent of any one of embodiments 1-3, wherein a nucleic acid sequence of the antisense strand comprises usCfsasUfgauacugAfgAfgCfuugcsu (SEQ ID NO:1077) and a nucleic acid sequence of the sense strand comprises agcaagcuCfUfCfaguaucauga (SEQ ID NO:1671), wherein lower case (n)=2'-O-Me; Nf=2'-F; and s=phosphorothioate backbone modification.

Embodiment 62. The RNAi agent of any one of embodiments 1-3, wherein a nucleic acid sequence of the antisense strand comprises usCfsasUfgauacugAfgAfgCfuugcsu (SEQ ID NO:1077) and the sense strand comprises (invAb) sagcaagcuCfUfCfaguaucaugas(invAb) (SEQ ID NO:1688), wherein lower case (n)=2'-O-Me; Nf=2'-F; (invAb)=inverted abasic residue; and s=phosphorothioate backbone modification.

Embodiment 63. The RNAi agent of any one of embodiments 31-62, wherein the 5' end of the sense strand is coupled to a targeting ligand comprising the structure of (NAG37) or (NAG37)s.

Embodiment 64. The RNAi agent of any one of embodiments 31-62, wherein the 5' end of the sense strand is coupled to a targeting ligand comprising the structure of (NAG37)s.

Embodiment 65. The RNAi agent of any one of embodiments 31-64, wherein RNAi agent is a pharmaceutically acceptable salt.

Embodiment 66. A composition comprising the RNAi agent of any one of embodiments 1-65, wherein the composition further comprises a pharmaceutically acceptable excipient.

Embodiment 67. A method for inhibiting expression of an XDH gene in a cell, the method comprising introducing into a cell an effective amount of an RNAi agent of any one of embodiments 1-66 or the composition of embodiment 66.

Embodiment 68. The method of embodiment 67, wherein the cell is within a subject.

Embodiment 69. The method of embodiment 68, wherein the subject is a human subject.

Embodiment 70. The method of any one of embodiments 67-69, wherein the XDH gene expression is inhibited by at least about 30%.

Embodiment 71. The method of any one of embodiments 67-70, wherein the XDH activity is reduced by at least about 40%, about 45%, about 50%, about 55%, about 60%, about 65%, or about 70%.

Embodiment 72. A method of treating an XDH-related disease, disorder, or symptom, the method comprising administering to a human subject in need thereof a therapeutically effective amount of the composition of embodiment 66.

Embodiment 73. The method of embodiment 72, wherein the disease is gout.

Embodiment 74. The method of any one of embodiments 67-73, wherein the RNAi agent is administered at a dose of about 0.05 mg/kg to about 5.0 mg/kg of body weight of the human subject.

Embodiment 75. The method of any one of embodiments 67-74, wherein the RNAi agent is administered in two or more doses.

Embodiment 76. A single-stranded antisense compound for inhibiting an XDH gene, comprising an antisense nucleotide sequence having at least 15 contiguous nucleotides differing by 0, 1, 2, or 3 nucleotides, wherein the nucleotides are complementary to any of the target nucleotide sequences of Table 1.

Embodiment 77. A single-stranded antisense compound for inhibiting an XDH gene, comprising at least 15 contiguous nucleotides differing by 0, 1, 2, or 3 nucleotides of any of the antisense strand sequences disclosed in Table 2, Table 3, or Table 5C.

The above provided embodiments and items are now illustrated with the following, non-limiting examples.

EXAMPLES

Example 1

Synthesis of XDH RNAi Agents

XDH RNAi agent duplexes shown in Tables 5A, 5B, and 5C, above, were synthesized in accordance with the following general procedures:

A. Synthesis.

The sense and antisense strands of the RNAi agents were synthesized according to phosphoramidite technology on solid phase used in oligonucleotide synthesis. Such standard synthesis is generally known in the art. Depending on the scale, either a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, Pa., USA). The monomer positioned at the 3' end of the respective strand was attached to the solid support as a starting point for synthesis. All RNA and 2'-modified RNA phosphoramidites were purchased from Thermo Fisher Scientific (Milwaukee, Wis., USA) or Hongene Biotech (Shanghai, PRC). The 2'-O-methyl phosphoramidites included the following: (5'-O-dimethoxytrityl-$N^6$-(benzoy0-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl amidites. 5'-(4,4'-Dimethoxytrityl)-2',3'-seco-uridine, 2'-benzoyl-3'-[(2-cyanoethyl)-(N,N-diisopropyl)]-phosphoramidite was also purchased from Thermo Fisher Scientific or Hongene Biotech. 5'-dimethoxytrityl-2'-O-methyl-inosine-3'-O-(2-cyanoethyl-N,N-diisopropylamino) phosphoramidites were purchased from Glen Research (Virginia) or Hongene Biotech. The cyclopropyl phosphonate phosphoramidites were synthesized in accordance with International Patent Application Publication No. WO 2017/214112 (see also Altenhofer et. al., Chem. Communications (Royal Soc. Chem.), 57(55): 6808-6811 (July 2021)). The inverted abasic (3'-O-dimethoxytrityl-2'-deoxyribose-5'-O-(2-cyanoethyl-N,N-diisopropylamino) phosphoramidites were purchased from ChemGenes (Wilmington, Mass., USA) or SAFC (St Louis, Mo., USA). 5'-O-dimethoxytrityl-$N^2$,$N^6$-(phenoxyacetate)-2'-O-methyl-diaminopurine-3'-O-(2-cyanoethyl-N,N-diisopropylamino) phosphoramidites were obtained from ChemGenes or Hongene Biotech.

Targeting ligand-containing phosphoramidites were dissolved in anhydrous dichloromethane or anhydrous acetonitrile (50 mM), while all other amidites were dissolved in anhydrous acetonitrile (50 mM), or anhydrous dimethylformamide and molecular sieves (3 Å) were added. 5-Benzylthio-1H-tetrazole (BTT, 250 mM in acetonitrile) or 5-Ethylthio-1H-tetrazole (ETT, 250 mM in acetonitrile) was used as activator solution. Coupling times were 12 min (RNA), 15 min (targeting ligand), 90 sec (2'-OMe), and 60 sec (2'-F). In order to introduce phosphorothioate linkages, a 100 mM solution of 3-phenyl 1,2,4-dithiazoline-5-one (POS, obtained from PolyOrg, Inc., Leominster, Mass., USA) in anhydrous Acetonitrile was employed. Unless specifically identified as a "naked" RNAi agent having no targeting ligand present, each of the XDH RNAi agent duplexes synthesized and tested in the following Examples utilized N-acetyl-galactosamine as "NAG" in the targeting ligand chemical structures represented in Table 6. (NAG37) and (NAG37)s targeting ligand phosphoramidite compounds can be synthesized in accordance with International Patent Application Publication No. WO 2018/044350 to Arrowhead Pharmaceuticals, Inc.

B. Cleavage and Deprotection of Support Bound Oligomer

After finalization of the solid phase synthesis, the dried solid support was treated with a 1:1 volume solution of 40 wt. % methylamine in water and 28% ammonium hydroxide solution (Aldrich) for 1.5 hours at 30° C. The solution was evaporated and the solid residue was reconstituted in water (see below).

C. Purification.

Crude oligomers were purified by anionic exchange HPLC using a TSKgel SuperQ-5PW 13 μm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 26/40 column packed with Sephadex G-25 fine with a running buffer of filtered DI water or 100 mM ammonium bicarbonate, pH 6.7 and 20% Acetonitrile.

D. Annealing.

Complementary strands were mixed by combining equimolar RNA solutions (sense and antisense) in 1×Phosphate-Buffered Saline (Corning, Cellgro) to form the RNAi agents. Some RNAi agents were lyophilized and stored at −15 to −25° C. Duplex concentration was determined by measuring the solution absorbance on a UV-Vis spectrometer in 1× Phosphate-Buffered Saline. The solution absorbance at 260 nm was then multiplied by a conversion factor and the dilution factor to determine the duplex concentration. The conversion factor used was either 0.050 mg/(mLcm) or was calculated from an experimentally determined extinction coefficient.

Example 2

XDH-GLuc AAV Mouse Model

To evaluate certain XDH RNAi agents, an XDH-GLuc (Gaussia Luciferase) AAV (Adeno-associated virus) mouse model was used. Six- to eight-week-old male C57BL/6 mice were transduced with XDH-GLuc AAV serotype 8, administered at least 14 days prior to administration of an XDH RNAi agent or control. Two types of XDH-GLuc AAV were used. The genome of the first XDH-GLuc AAV contains the 80-2899 region of the human XDH cDNA sequence (GenBank NM_000379.4 (SEQ ID NO:1)) inserted into the 3' UTR of the GLuc reporter gene sequence. The genome of the second XDH-GLuc AAV contains the 2820-5715 region of the human XDH cDNA sequence (GenBank NM_000379.4 (SEQ ID NO:1)) inserted into the 3' UTR of the GLuc reporter gene sequence. 5E12 to 1E13 GC/kg of the respective virus in PBS in a total volume of 10 mL/kg animal's body weight was injected into mice via the tail vein to create XDH-GLuc AAV model mice. Inhibition of expression of XDH by an XDH RNAi agent results in concomitant inhibition of GLuc expression, which is measured. Prior to administration of a treatment (between day −7 and day 1 pre-dose), GLuc expression levels in serum were measured by the Pierce™ Gaussia Luciferase Glow Assay Kit (Thermo Fisher Scientific), and the mice were grouped according to average GLuc levels.

Mice were anesthetized with 2-3% isoflurane and blood samples were collected from the submandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C. Serum was collected and measured by the Pierce™ Gaussia Luciferase Glow Assay Kit according to the manufacturer's instructions. Serum GLuc levels for each animal can be normalized to the control group of mice injected with vehicle control in order to account for the non-treatment related shift in XDH expression with this model. To do so, first, the GLuc level for each animal at a time point was divided by the pre-treatment level of expression in that animal (Day 1) in order to determine the ratio of expression "normalized to pre-treatment". Expression at a specific time point was then normalized to the control group by dividing the "normalized to pre-treatment" ratio for an individual animal by the average "normalized to pre-treatment" ratio of all mice in the normal vehicle control group. Alternatively, the serum GLuc levels for each animal was assessed by normalizing to pre-treatment levels only.

Example 3

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 7.

TABLE 7

Targeted Positions and Dosing Groups of Example 3

| Group | Targeted Gene Position (within SEQ ID NO: 1) | RNAi Agent and Dose | Dosing Regimen |
|---|---|---|---|
| 1 | N/A | Saline (no RNAi agent) | Single injection on day 1 |
| 2 | 488 | 2.0 mg/kg AD09218 | Single injection on day 1 |
| 3 | 122 | 2.0 mg/kg AD09724 | Single injection on day 1 |
| 4 | 249 | 2.0 mg/kg AD09599 | Single injection on day 1 |
| 5 | 252 | 2.0 mg/kg AD09600 | Single injection on day 1 |
| 6 | 1285 | 2.0 mg/kg AD09733 | Single injection on day 1 |
| 7 | 2209 | 2.0 mg/kg AD09740 | Single injection on day 1 |
| 8 | 1963 | 2.0 mg/kg AD09736 | Single injection on day 1 |
| 9 | 1963 | 2.0 mg/kg AD09937 | Single injection on day 1 |
| 10 | 2696 | 2.0 mg/kg AD09744 | Single injection on day 1 |
| 11 | 2696 | 2.0 mg/kg AD09938 | Single injection on day 1 |
| 12 | 2616 | 2.0 mg/kg AD09663 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agent AD09218 (Group 2) included nucleotide sequences that were designed to inhibit expression of an XDH gene at position 488 of the gene; the XDH RNAi agent AD09724 (Group 3) included nucleotide sequences that were designed to inhibit expression of an XDH gene at position 122 of the gene; the XDH RNAi agent AD09599 (Group 4) included nucleotide sequences that were designed to inhibit expression of an XDH gene at position 249 of the gene; the XDH RNAi agent AD09600 (Group 5) included nucleotide sequences that were designed to inhibit expression of an XDH gene at position 252 of the gene; the XDH RNAi agent AD09733 (Group 6) included nucleotide sequences that were designed to inhibit expression of an XDH gene at position 1285 of the gene; the XDH RNAi agent AD09740 (Group 7) included nucleotide sequences that were designed to inhibit expression of an XDH gene at position 2209 of the gene; the XDH RNAi agents AD09736 (Group 8) and AD09937 (Group 9) included nucleotide sequences that were designed to inhibit expression of an XDH gene at position 1963 of the gene; the XDH RNAi agents AD09744 (Group 10) and AD09938 (Group 11) included nucleotide sequences that were designed to inhibit expression of an XDH gene at position 2696 of the gene; and the XDH RNAi agent AD09663 (Group 12) included nucleotide sequences that were designed to inhibit expression of an XDH gene at position 2616 of the gene. (See, e.g., SEQ ID NO:1 and Table 2 for the XDH gene referenced).

While it has been previously reported that an RNAi agent targeting position 488 of the XDH gene can be active in vitro and in vivo in mice and in rats, the nucleotide sequence of an RNAi agent targeting this position is compromised and unsuitable for therapeutic use. More specifically, the seed region (2 to 7 nt) of the RNAi agent targeting position 488 matches perfectly with that of a known human microRNA (miRNA), thus this agent is expected to result in undesired silencing of hundreds of potential off-targets mimicking the known miRNA (See, e.g., Kamola et al., The siRNA Non-seed Region and Its Target Sequences Are Auxiliary Determinants of Off-Target Effects, 11(12) PLoS Comput Biol (2015)). In addition, the core 17-mer sequence (nucleotides located at positions 2-18 of the antisense strand (5'→3')) of the RNAi agent targeting position 488 is complementary to transcripts of four human genes with only one mismatch, hence bearing an additional risk of reducing the expression of these four genes through a different off-target mechanism. Thus, the RNAi agent of Group 2 is not a viable candidate for human therapeutic treatment.

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2, above. Data from the experiment are shown in the following Table 8:

TABLE 8

| Average XDH Normalized to Pre-Treatment & Control in XDH-GLUC AAV Mice from Example 3 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.105 | 1.000 | 0.020 | 1.000 | 0.096 |
| Group 2 (2.0 mg/kg AD09218) | 0.601 | 0.094 | 0.505 | 0.085 | 0.531 | 0.103 |
| Group 3 (2.0 mg/kg AD09724) | 1.115 | 0.149 | 0.890 | 0.095 | 0.964 | 0.208 |
| Group 4 (2.0 mg/kg AD09599) | 1.009 | 0.088 | 0.872 | 0.096 | 0.991 | 0.092 |
| Group 5 (2.0 mg/kg AD09600) | 0.874 | 0.292 | 0.865 | 0.415 | 0.927 | 0.348 |
| Group 6 (2.0 mg/kg AD09733) | 1.024 | 0.054 | 0.896 | 0.129 | 1.209 | 0.262 |
| Group 7 (2.0 mg/kg AD09740) | 0.963 | 0.083 | 0.793 | 0.103 | 1.132 | 0.084 |
| Group 8 (2.0 mg/kg AD09736) | 0.607 | 0.154 | 0.521 | 0.111 | 0.809 | 0.135 |
| Group 9 (2.0 mg/kg AD09937) | 0.673 | 0.148 | 0.593 | 0.120 | 0.748 | 0.108 |
| Group 10 (2.0 mg/kg AD09744) | 0.679 | 0.084 | 0.694 | 0.078 | 0.934 | 0.163 |
| Group 11 (2.0 mg/kg AD09938) | 0.552 | 0.076 | 0.478 | 0.076 | 0.711 | 0.095 |
| Group 12 (2.0 mg/kg AD09663) | 0.826 | 0.102 | 0.849 | 0.435 | 1.246 | 0.895 |

As shown in Table 8, above, as expected the RNAi agent of Group 2 (targeting position 488) was active and showed reductions of approximately 49.5% on day 15 (0.505). The RNAi agents of Group 8 (AD09736) and Group 9 (AD09937), both of which target the XDH gene at position 1963, showed generally comparable reductions of XDH (reductions of 47.9% and 40.7% on day 15, respectively) with Group 2. Similarly, the RNAi agents of Group 10 (AD09744) and Group 11 (AD09938), both of which target the XDH gene at position 2696, showed generally comparable reductions of XDH (showing reductions of 30.6% and 52.2%) with Group 2.

Example 4

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 9.

TABLE 9

| Targeted Positions and Dosing Groups of Example 4 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 1963 | 2.0 mg/kg AD09736 | Single injection on day 1 |
| 3 | 1963 | 2.0 mg/kg AD09965 | Single injection on day 1 |
| 4 | 1963 | 2.0 mg/kg AD09937 | Single injection on day 1 |
| 5 | 1963 | 2.0 mg/kg AD09966 | Single injection on day 1 |
| 6 | 1963 | 2.0 mg/kg AD09967 | Single injection on day 1 |
| 7 | 1963 | 2.0 mg/kg AD09968 | Single injection on day 1 |
| 8 | 1963 | 2.0 mg/kg AD09969 | Single injection on day 1 |
| 9 | 1963 | 2.0 mg/kg AD09970 | Single injection on day 1 |
| 10 | 1964 | 2.0 mg/kg AD09962 | Single injection on day 1 |
| 11 | 1965 | 2.0 mg/kg AD09963 | Single injection on day 1 |
| 12 | 1967 | 2.0 mg/kg AD09964 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents AD09736 (Group 2), AD09965 (Group 3), AD09937 (Group 4), AD09966 (Group 5), AD09967 (Group 6), AD09968 (Group 7), AD09969 (Group 8), and AD09970 (Group 9) all included nucleotide sequences that were designed to inhibit expression of an XDH gene at position 1963 of the gene; the XDH RNAi agent AD09962 (Group 10) included nucleotide sequences that were designed to inhibit expression of an XDH gene at position 1964 of the gene; the XDH RNAi agent AD09963 (Group 11) included nucleotide sequences that were designed to inhibit expression of an XDH gene at position 1965 of the gene; and the XDH RNAi agent AD09964 (Group 12) included nucleotide sequences that were designed to inhibit expression of an XDH gene at position 1967 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2, above. Data from the experiment are shown in the following Table 10:

TABLE 10

| Average XDH Normalized to Pre-Treatment & Control in XDH-GLUC AAV Mice from Example 4 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.136 | 1.000 | 0.205 | 1.000 | 0.110 |
| Group 2 (2.0 mg/kg AD09218) | 0.625 | 0.146 | 0.603 | 0.078 | 0.642 | 0.066 |
| Group 3 (2.0 mg/kg AD09965) | 0.812 | 0.143 | 0.623 | 0.182 | 0.670 | 0.198 |
| Group 4 (2.0 mg/kg AD09937) | 0.502 | 0.045 | 0.581 | 0.183 | 0.528 | 0.099 |
| Group 5 (2.0 mg/kg AD09966) | 0.486 | 0.093 | 0.469 | 0.173 | 0.502 | 0.207 |
| Group 6 (2.0 mg/kg AD09967) | 0.644 | 0.065 | 0.490 | 0.141 | 0.483 | 0.084 |
| Group 7 (2.0 mg/kg AD09968) | 0.551 | 0.244 | 0.599 | 0.234 | 0.554 | 0.168 |
| Group 8 (2.0 mg/kg AD09969) | 0.603 | 0.105 | 0.573 | 0.078 | 0.611 | 0.118 |
| Group 9 (2.0 mg/kg AD09970) | 0.659 | 0.228 | 0.618 | 0.230 | 0.621 | 0.110 |
| Group 10 (2.0 mg/kg AD09962) | 0.820 | 0.161 | 0.818 | 0.132 | 0.744 | 0.093 |
| Group 11 (2.0 mg/kg AD09963) | 0.793 | 0.061 | 0.743 | 0.065 | 0.722 | 0.095 |
| Group 12 (2.0 mg/kg AD09664) | 0.836 | 0.088 | 0.783 | 0.146 | 0.683 | 0.058 |

As shown in Table 10, above, the RNAi agents of Groups 2-9, which all included nucleotide sequences targeting position 1963 of the XDH gene, reported substantial inhibitory activity, with certain XDH RNAi agents achieving greater than 50% inhibition in vivo. Further, the XDH RNAi agents of each of Groups 2-9, all of which target position 1963 of the XDH gene, generally showed an increase in inhibition of XDH gene expression of approximately 20-35% compared to sequences targeting neighboring positions of an XDH gene, shown in Groups 10-12 (Compare, for example, Group 5 (AD09600) at day 15 showing 53.1% inhibition (0.469) with Groups 10-12 at day 15 showing 18.2% inhibition (0.818); 25.7% inhibition (0.743); and 21.7% inhibition (0.783), respectively).

Example 5

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 11.

TABLE 11

| Targeted Positions and Dosing Groups of Example 5 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 2696 | 2.0 mg/kg AD09744 | Single injection on day 1 |
| 3 | 2696 | 2.0 mg/kg AD09938 | Single injection on day 1 |
| 4 | 2696 | 2.0 mg/kg AD10008 | Single injection on day 1 |

TABLE 11-continued

| Targeted Positions and Dosing Groups of Example 5 | | | |
|---|---|---|---|
| Group | Targeted Gene Position (within SEQ ID NO: 1) | RNAi Agent and Dose | Dosing Regimen |
| 5 | 2696 | 2.0 mg/kg AD10009 | Single injection on day 1 |
| 6 | 2696 | 2.0 mg/kg AD10010 | Single injection on day 1 |
| 7 | 2696 | 2.0 mg/kg AD10011 | Single injection on day 1 |
| 8 | 2696 | 2.0 mg/kg AD10012 | Single injection on day 1 |
| 9 | 2696 | 2.0 mg/kg AD10013 | Single injection on day 1 |
| 10 | 2696 | 2.0 mg/kg AD10014 | Single injection on day 1 |
| 11 | 2696 | 2.0 mg/kg AD10015 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents of Groups 2-11 all included nucleotide sequences that were designed to inhibit expression of an XDH gene at position 2696 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8 (and planned to be collected on days 15, and day 22), and XDH expression levels were determined pursuant to the procedure set forth in Example 2, above. Data from the experiment through day 22 are shown in the following Table 12:

TABLE 12

| Average XDH Normalized to Pre-Treatment & Control in XDH-GLUC AAV Mice from Example 5 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.183 | 1.000 | 0.274 | 1.000 | 0.213 |
| Group 2 (2.0 mg/kg AD09744) | 0.818 | 0.161 | 0.615 | 0.092 | 0.800 | 0.255 |
| Group 3 (2.0 mg/kg AD09938) | 0.669 | 0.120 | 0.606 | 0.099 | 0.699 | 0.128 |
| Group 4 (2.0 mg/kg AD10008) | 0.786 | 0.140 | 0.627 | 0.248 | 0.744 | 0.102 |
| Group 5 (2.0 mg/kg AD10009) | 0.671 | 0.364 | 0.457 | 0.133 | 0.550 | 0.241 |
| Group 6 (2.0 mg/kg AD10010) | 0.591 | 0.134 | 0.535 | 0.103 | 0.494 | 0.105 |
| Group 7 (2.0 mg/kg AD10011) | 0.589 | 0.280 | 0.432 | 0.169 | 0.546 | 0.144 |
| Group 8 (2.0 mg/kg AD10012) | 0.362 | 0.077 | 0.295 | 0.055 | 0.369 | 0.029 |
| Group 9 (2.0 mg/kg AD10013) | 0.393 | 0.073 | 0.482 | 0.054 | 0.577 | 0.061 |
| Group 10 (2.0 mg/kg AD10014) | 0.423 | 0.055 | 0.426 | 0.082 | 0.548 | 0.100 |
| Group 11 (2.0 mg/kg AD10015) | 0.502 | 0.034 | 0.477 | 0.056 | 0.535 | 0.077 |

As shown in Table 12, each of the RNAi agents of Groups 2-11, which all included nucleotide sequences targeting position 2696 of the XDH gene, reported substantial inhibitory activity of XDH gene expression.

Example 6

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 13.

TABLE 13

| Targeted Positions and Dosing Groups of Example 6 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 488 | 2.0 mg/kg AD09218 | Single injection on day 1 |
| 3 | 231 | 2.0 mg/kg AD10016 | Single injection on day 1 |
| 4 | 242 | 2.0 mg/kg AD10017 | Single injection on day 1 |
| 5 | 1322 | 2.0 mg/kg AD09734 | Single injection on day 1 |
| 6 | 1322 | 2.0 mg/kg AD10091 | Single injection on day 1 |
| 7 | 1322 | 2.0 mg/kg AD10092 | Single injection on day 1 |
| 8 | 1322 | 2.0 mg/kg AD10093 | Single injection on day 1 |
| 9 | 1322 | 2.0 mg/kg AD10094 | Single injection on day 1 |
| 10 | 1322 | 2.0 mg/kg AD10095 | Single injection on day 1 |
| 11 | 1322 | 2.0 mg/kg AD10096 | Single injection on day 1 |
| 12 | 1322 | 2.0 mg/kg AD10097 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agent AD09218 (Group 2) included nucleotide sequences that were designed to inhibit expression of an XDH gene at position 488 of the gene; the XDH RNAi agent AD10016 (Group 3) included nucleotide sequences that were designed to inhibit expression of an XDH gene at position 231 of the gene; the XDH RNAi agent AD10017 (Group 4) included nucleotide sequences that were designed to inhibit expression of an XDH gene at position 242 of the gene; and the XDH RNAi agents AD09734 (Group 5), AD10091 (Group 6), AD10092 (Group 7), AD10093 (Group 8), AD10094 (Group 9), AD10095 (Group 10), AD10096 (Group 11), and AD10097 (Group 12) included nucleotide sequences that were designed to inhibit expression of an XDH gene at position 1322 of the gene. (See, e.g., SEQ ID NO:1 and Table 2 for the XDH gene referenced).

As noted in Example 3, above, the RNAi agent targeting position 488 of the XDH gene (Group 2), while previously reported to be active in vivo in mice and rats, includes a compromised nucleotide sequence and is unsuitable for therapeutic use due to toxicity concerns.

The injections were performed between the skin and muscle (i.e. subcutaneous injections) into the loose skin over the neck and shoulder area. Four (4) mice in each group were tested (n=4). Serum was collected on day 1 (pre-treatment), day 8 (and planned for days 15 and day 22), and XDH expression levels were determined pursuant to the procedure set forth in Example 2, above. Data from the experiment through day 8 are shown in the following Table 14:

TABLE 14

| Average XDH Normalized to Pre-Treatment & Control in XDH-GLUC AAV Mice from Example 6 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.069 | 1.000 | 0.046 | 1.000 | 0.058 |
| Group 2 (2.0 mg/kg AD09218) | 0.550 | 0.223 | 0.489 | 0.204 | 0.461 | 0.116 |
| Group 3 (2.0 mg/kg AD10016) | 0.652 | 0.098 | 0.700 | 0.115 | 0.620 | 0.092 |
| Group 4 (2.0 mg/kg AD10017) | 0.645 | 0.085 | 0.640 | 0.154 | 0.632 | 0.064 |
| Group 5 (2.0 mg/kg AD09734) | 0.718 | 0.059 | 0.705 | 0.119 | 0.632 | 0.087 |
| Group 6 (2.0 mg/kg AD10091) | 0.673 | 0.112 | 0.757 | 0.157 | 0.673 | 0.100 |
| Group 7 (2.0 mg/kg AD10092) | 0.757 | 0.031 | 0.694 | 0.085 | 0.633 | 0.089 |
| Group 8 (2.0 mg/kg AD10093) | 0.717 | 0.039 | 0.752 | 0.117 | 0.634 | 0.082 |
| Group 9 (2.0 mg/kg AD10094) | 0.728 | 0.071 | 0.727 | 0.219 | 0.664 | 0.106 |
| Group 10 (2.0 mg/kg AD10095) | 0.805 | 0.193 | 0.776 | 0.110 | 0.767 | 0.170 |
| Group 11 (2.0 mg/kg AD10096) | 0.536 | 0.044 | 0.587 | 0.147 | 0.561 | 0.093 |
| Group 12 (2.0 mg/kg AD10097) | 0.839 | 0.383 | 0.952 | 0.450 | 1.033 | 0.632 |

Example 7

In Vivo Testing of XDH RNAi Agents in XDH-GLuc AAV Mice

The XDH-GLUC AAV mouse model described in Example 2, above, using the XDH-GLuc AAV containing the 2820-5715 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 15.

TABLE 15

| Targeted Positions and Dosing Groups of Example 7 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 3083 | 2.0 mg/kg AD09325 | Single injection on day 1 |
| 3 | 2995 | 2.0 mg/kg AD09981 | Single injection on day 1 |
| 4 | 3016 | 2.0 mg/kg AD09982 | Single injection on day 1 |
| 5 | 3041 | 2.0 mg/kg AD09983 | Single injection on day 1 |
| 6 | 3498 | 2.0 mg/kg AD09984 | Single injection on day 1 |
| 7 | 3598 | 2.0 mg/kg AD09985 | Single injection on day 1 |
| 8 | 3877 | 2.0 mg/kg AD09987 | Single injection on day 1 |
| 9 | 4394 | 2.0 mg/kg AD09989 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agent AD09325 (Group 2) included nucleotide sequences that were designed to inhibit expression of an XDH gene at position 3083 of the gene; the XDH RNAi agent AD09981 (Group 3) included nucleotide sequences that were designed to inhibit expression of an XDH gene at position 2995 of the gene; the XDH RNAi agent AD09982 (Group 4) included nucleotide sequences that were designed to inhibit expression of an XDH gene at position 3016 of the gene; the XDH RNAi agent AD09983 (Group 5) included nucleotide sequences that were designed to inhibit expression of an XDH gene at position 3041 of the gene; the XDH RNAi agent AD09984 (Group 6) included nucleotide sequences that were designed to inhibit expression of an XDH gene at position 3498 of the gene; the XDH RNAi agent AD09985 (Group 7) included nucleotide sequences that were designed to inhibit expression of an XDH gene at position 3598 of the gene; the XDH RNAi agent AD09987 (Group 8) included nucleotide sequences that were designed to inhibit expression of an XDH gene at position 3877 of the gene; and the XDH RNAi agent AD09989 (Group 9) included nucleotide sequences that were designed to inhibit expression of an XDH gene at position 4394 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2, above. Data from the experiment are shown in the following Table 16:

TABLE 16

| Average XDH Normalized to Pre-Treatment & Control in XDH-GLUC AAV Mice from Example 7 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.375 | 1.000 | 0.397 | 1.000 | 0.397 |
| Group 2 (2.0 mg/kg AD09325) | 0.513 | 0.078 | 0.823 | 0.154 | 0.823 | 0.154 |

TABLE 16-continued

| Average XDH Normalized to Pre-Treatment & Control in XDH-GLUC AAV Mice from Example 7 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 3 (2.0 mg/kg AD09981) | 0.600 | 0.040 | 0.681 | 0.129 | 0.681 | 0.129 |
| Group 4 (2.0 mg/kg AD09982) | 0.592 | 0.058 | 0.631 | 0.137 | 0.631 | 0.137 |
| Group 5 (2.0 mg/kg AD09983) | 0.596 | 0.066 | 0.574 | 0.087 | 0.574 | 0.087 |
| Group 6 (2.0 mg/kg AD09984) | 0.724 | 0.043 | 0.941 | 0.221 | 0.941 | 0.221 |
| Group 7 (2.0 mg/kg AD09985) | 0.472 | 0.076 | 0.449 | 0.092 | 0.449 | 0.092 |
| Group 8 (2.0 mg/kg AD09987) | 0.691 | 0.225 | 0.751 | 0.149 | 0.751 | 0.149 |
| Group 9 (2.0 mg/kg AD09989) | 0.585 | 0.076 | 0.757 | 0.120 | 0.757 | 0.120 |

As shown in Table 16, each of the RNAi agents of Groups 2-9, reported inhibition of XDH gene expression.

Example 8

In Vivo Testing of XDH RNAi Agents in XDH-GLuc AAV Mice

The XDH-GLUC AAV mouse model described in Example 2, above, using the XDH-GLuc AAV containing the 2820-5715 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 17.

TABLE 17

| Targeted Positions and Dosing Groups of Example 8 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 3083 | 2.0 mg/kg AD09325 | Single injection on day 1 |
| 3 | 3600 | 2.0 mg/kg AD09986 | Single injection on day 1 |
| 4 | 3930 | 2.0 mg/kg AD09988 | Single injection on day 1 |
| 5 | 4513 | 2.0 mg/kg AD09990 | Single injection on day 1 |
| 6 | 4531 | 2.0 mg/kg AD09991 | Single injection on day 1 |
| 7 | 4666 | 2.0 mg/kg AD09992 | Single injection on day 1 |
| 8 | 4843 | 2.0 mg/kg AD09993 | Single injection on day 1 |

TABLE 17-continued

| Targeted Positions and Dosing Groups of Example 8 | | | |
|---|---|---|---|
| Group | Targeted Gene Position (within SEQ ID NO: 1) | RNAi Agent and Dose | Dosing Regimen |
| 9 | 5234 | 2.0 mg/kg AD09994 | Single injection on day 1 |
| 10 | 5411 | 2.0 mg/kg AD09995 | Single injection on day 1 |
| 11 | 4136 | 2.0 mg/kg AD09608 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-11 each included nucleotide sequences that were designed to inhibit expression of an XDH gene at the specific positions of the gene as set forth in Table 17, above. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8 (and planned to be collected on days 15, and day 22), and XDH expression levels were determined pursuant to the procedure set forth in Example 2, above. Data from the experiment through day 8 are shown in the following Table 18:

TABLE 18

| Average XDH Normalized to Pre-Treatment & Control in XDH-GLUC AAV Mice from Example 8 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.119 | 1.000 | 0.059 | 1.000 | 0.177 |
| Group 2 (2.0 mg/kg AD09325) | 0.650 | 0.022 | 0.628 | 0.083 | 0.548 | 0.143 |
| Group 3 (2.0 mg/kg AD09986) | 0.999 | 0.145 | 0.628 | 0.090 | 0.625 | 0.086 |
| Group 4 (2.0 mg/kg AD09988) | 0.616 | 0.163 | 0.746 | 0.284 | 0.756 | 0.149 |
| Group 5 (2.0 mg/kg AD09990) | 0.617 | 0.190 | 0.901 | 0.197 | 0.971 | 0.283 |
| Group 6 (2.0 mg/kg AD09991) | 0.883 | 0.154 | 0.782 | 0.134 | 0.728 | 0.156 |
| Group 7 (2.0 mg/kg AD09992) | 1.020 | 0.074 | 0.808 | 0.039 | 0.788 | 0.074 |
| Group 8 (2.0 mg/kg AD09993) | 0.961 | 0.048 | 0.775 | 0.122 | 0.831 | 0.169 |

TABLE 18-continued

Average XDH Normalized to Pre-Treatment & Control in XDH-GLUC AAV Mice from Example 8

| Group ID | Day 8 | | Day 15 | | Day 22 | |
|---|---|---|---|---|---|---|
| | Avg XDH | Std Dev (+/−) | Avg XDH | Std Dev (+/−) | Avg XDH | Std Dev (+/−) |
| Group 9 (2.0 mg/kg AD09994) | 1.334 | 0.237 | 1.005 | 0.121 | 1.193 | 0.357 |
| Group 10 (2.0 mg/kg AD09995) | 0.795 | 0.095 | 0.729 | 0.120 | 0.777 | 0.137 |
| Group 11 (2.0 mg/kg AD09608) | 0.993 | 0.103 | 0.744 | 0.267 | 0.435 | 0.088 |

Example 9

In Vivo Testing of XDH RNAi Agents in Wild-Type Mice

Certain XDH RNAi agents have sufficient homology with the mouse XDH gene transcript that they are suitable to be examined for XDH gene expression inhibitory activity in wild-type mice. At day 1, six- to eight-week-old female C57b1/6 mice were given a single subcutaneous administration of 200 μl/20 g animal weight containing 1.0 mg/kg (mpk) of an XDH RNAi agent formulated in isotonic saline, or vehicle control (isotonic saline with no RNAi agent), according to the following Table 19.

TABLE 19

Targeted Positions and Dosing Groups of Example 9

| Group | Targeted Gene Position (within SEQ ID NO: 1) | RNAi Agent and Dose | Dosing Regimen |
|---|---|---|---|
| 1 | N/A | Saline (no RNAi agent) | Single injection on day 1 |
| 2 | 488 | 1.0 mg/kg AD09217 | Single injection on day 1 |
| 3 | 488 | 1.0 mg/kg AD09218 | Single injection on day 1 |
| 4 | 1612 | 1.0 mg/kg AD09219 | Single injection on day 1 |
| 5 | 1614 | 1.0 mg/kg AD09220 | Single injection on day 1 |
| 6 | 1617 | 1.0 mg/kg AD09221 | Single injection on day 1 |
| 7 | 2128 | 1.0 mg/kg AD09222 | Single injection on day 1 |
| 8 | 2130 | 1.0 mg/kg AD09223 | Single injection on day 1 |
| 9 | 2131 | 1.0 mg/kg AD09224 | Single injection on day 1 |
| 10 | 2132 | 1.0 mg/kg AD09225 | Single injection on day 1 |
| 11 | 2153 | 1.0 mg/kg AD09226 | Single injection on day 1 |
| 12 | 2185 | 1.0 mg/kg AD09227 | Single injection on day 1 |
| 13 | 2186 | 1.0 mg/kg AD09228 | Single injection on day 1 |
| 14 | 3272 | 1.0 mg/kg AD09229 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-14 each included nucleotide sequences that, while also being homologous to the mouse XDH gene transcript, were designed to inhibit expression of an XDH gene at the specific positions of the human XDH gene as set forth in Table 19, above. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Mice were euthanized on study day 10, and total RNA was isolated from both livers following collection and homogenization. Mouse XDH mRNA expression was quantitated by probe-based quantitative PCR, normalized to mouse beta-actin expression, and expressed as fraction of vehicle control group (geometric mean, +/−95% confidence interval).

TABLE 20

Average Relative Mouse XDH mRNA at Sacrifice (Day 10) in Example 9

| Group ID | Average Relative mXDH mRNA | Low (error) | High (error) |
|---|---|---|---|
| Group 1 (No Treatment) | 1.000 | 0.197 | 0.246 |
| Group 2 (1.0 mg/kg AD09217) | 0.600 | 0.100 | 0.119 |
| Group 3 (1.0 mg/kg AD09218) | 0.628 | 0.132 | 0.167 |
| Group 4 (1.0 mg/kg AD09219) | 0.649 | 0.071 | 0.080 |
| Group 5 (1.0 mg/kg AD09220) | 0.943 | 0.157 | 0.188 |
| Group 6 (1.0 mg/kg AD09221) | 1.174 | 0.205 | 0.249 |
| Group 7 (1.0 mg/kg AD09222) | 1.098 | 0.242 | 0.310 |
| Group 8 (1.0 mg/kg AD09223) | 1.196 | 0.191 | 0.228 |
| Group 9 (1.0 mg/kg AD09224) | 1.348 | 0.179 | 0.207 |
| Group 10 (1.0 mg/kg AD09225) | 1.663 | 0.241 | 0.281 |
| Group 11 (1.0 mg/kg AD09226) | 1.711 | 0.126 | 0.136 |
| Group 12 (1.0 mg/kg AD09227) | 0.912 | 0.047 | 0.050 |
| Group 13 (1.0 mg/kg AD09228) | 0.983 | 0.114 | 0.128 |
| Group 14 (1.0 mg/kg AD09229) | 1.023 | 0.117 | 0.132 |

The data were normalized to the non-treatment group (Group 1). As noted above in, for example, Example 3, the RNAi agent targeting position 488 of the XDH gene of Group 2 (AD09217) and Group 3 (AD09218), while being previously identified as having activity in mice and rats in vivo, includes a compromised nucleotide sequence and is unsuitable for therapeutic use due to toxicity concerns. As shown in Table 20, above, the XDH RNAi agent AD09219 (Group 4), which targets position 1612 of the XDH gene transcript, showed mRNA reductions of approximately 35.1% (0.649) in mice, which was generally comparable to the reductions exhibited by the XDH RNAi agents of Group 2 (40% inhibition; (0.600)) and Group 3 (37.2% inhibition; (0.628)), which both included RNAi agents having sequences targeting position 488 of the XDH gene which as noted above has toxicity concerns.

Example 10

In Vivo Testing of XDH RNAi Agents in Wild-Type Mice

Certain XDH RNAi agents have sufficient homology with the mouse XDH gene transcript that they are suitable to be examined for XDH gene expression inhibitory activity in wild-type mice. At day 1, six- to eight-week-old male C57b1/6 mice were given a single subcutaneous administration of 200 μl/20 g animal weight containing 1.0 mg/kg (mpk) of an XDH RNAi agent formulated in isotonic saline, or vehicle control (isotonic saline with no RNAi agent), according to the following Table 21.

TABLE 21

| Targeted Positions and Dosing Groups of Example 10 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 1612 | 1.0 mg/kg AD09219 | Single injection on day 1 |
| 3 | 1612 | 1.0 mg/kg AD10021 | Single injection on day 1 |
| 4 | 1612 | 1.0 mg/kg AD10022 | Single injection on day 1 |
| 5 | 1612 | 1.0 mg/kg AD10023 | Single injection on day 1 |
| 6 | 1612 | 1.0 mg/kg AD10024 | Single injection on day 1 |
| 7 | 1612 | 1.0 mg/kg AD10025 | Single injection on day 1 |
| 8 | 1612 | 1.0 mg/kg AD10026 | Single injection on day 1 |
| 9 | 1612 | 1.0 mg/kg AD10027 | Single injection on day 1 |
| 10 | 1612 | 1.0 mg/kg AD10028 | Single injection on day 1 |
| 11 | 1612 | 1.0 mg/kg AD10029 | Single injection on day 1 |
| 12 | 1612 | 1.0 mg/kg AD10030 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-14 each included nucleotide sequences that, while also being homologous to the mouse XDH gene transcript, were designed to inhibit expression of an XDH gene at positions 1612 of the human XDH gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Mice were euthanized on study day 8, and total RNA was isolated from both livers following collection and homogenization. Mouse XDH mRNA expression was quantitated by probe-based quantitative PCR, normalized to mouse beta-actin expression, and expressed as fraction of vehicle control group (geometric mean, +/−95% confidence interval).

TABLE 22

| Average Relative Mouse XDH mRNA at Sacrifice (Day 8) in Example 10 | | | |
|---|---|---|---|
| Group ID | Average Relative mXDH mRNA | Low (error) | High (error) |
| Group 1 (No Treatment) | 1.000 | 0.242 | 0.319 |
| Group 2 (1.0 mg/kg AD09219) | 0.607 | 0.044 | 0.048 |
| Group 3 (1.0 mg/kg AD10021) | 0.653 | 0.139 | 0.177 |
| Group 4 (1.0 mg/kg AD10022) | 0.711 | 0.055 | 0.060 |
| Group 5 (1.0 mg/kg AD10023) | 0.609 | 0.067 | 0.076 |
| Group 6 (1.0 mg/kg AD10024) | 0.703 | 0.116 | 0.139 |
| Group 7 (1.0 mg/kg AD10025) | 0.659 | 0.083 | 0.095 |
| Group 8 (1.0 mg/kg AD10026) | 0.561 | 0.093 | 0.111 |
| Group 9 (1.0 mg/kg AD10027) | 0.540 | 0.090 | 0.108 |
| Group 10 (1.0 mg/kg AD10028) | 0.631 | 0.054 | 0.059 |
| Group 11 (1.0 mg/kg AD10029) | 0.440 | 0.042 | 0.046 |
| Group 12 (1.0 mg/kg AD10030) | 0.550 | 0.118 | 0.150 |

The data were normalized to the non-treatment group (Group 1). As shown in Table 22, above, each of the XDH RNAi agents targeting position 1612 (Groups 2-12) showed mouse mRNA reductions.

Example 11

In Vivo Testing of XDH RNAi Agents in Wild-Type Rats

Certain XDH RNAi agents have sufficient homology with the rat XDH gene transcript that they are suitable to be examined for XDH gene expression inhibitory activity in wild-type rats. At day 1, male Sprague Dawley rats were given a single subcutaneous administration of 4mL/1 kg animal weight containing a dose of an XDH RNAi agent formulated in isotonic saline, or vehicle control (isotonic saline with no RNAi agent), according to the following Table 23.

TABLE 23

| Targeted Positions and Dosing Groups of Example 11 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 488 | 10.0 mg/kg AD09218 | Single injection on day 1 |
| 3 | 488 | 3.0 mg/kg AD09218 | Single injection on day 1 |
| 4 | 488 | 1.0 mg/kg AD09218 | Single injection on day 1 |
| 5 | 488 | 0.3 mg/kg AD09218 | Single injection on day 1 |
| 6 | 2612 | 10.0 mg/kg AD09651 | Single injection on day 1 |
| 7 | 2612 | 3.0 mg/kg AD09651 | Single injection on day 1 |
| 8 | 2612 | 1.0 mg/kg AD09651 | Single injection on day 1 |
| 9 | 2612 | 0.3 mg/kg AD09651 | Single injection on day 1 |
| 10 | 2616 | 10.0 mg/kg AD09663 | Single injection on day 1 |
| 11 | 2616 | 3.0 mg/kg AD09663 | Single injection on day 1 |
| 12 | 2616 | 1.0 mg/kg AD09663 | Single injection on day 1 |
| 13 | 2616 | 0.3 mg/kg AD09663 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agent in Groups 2-5 (AD09218) included nucleotide sequences that, while also being homologous to the rat XDH gene transcript, were designed to inhibit expression of an XDH gene at position 488 of the human XDH gene; the XDH RNAi agent in Groups 6-9 (AD09651) included nucleotide sequences that, while also being homologous to the rat XDH gene transcript, were designed to inhibit expression of an XDH gene at position 2612 of the human XDH gene; and the XDH RNAi agents in Groups 10-13 (AD09663) included nucleotide sequences that, while also being homologous to the rat XDH gene transcript, were designed to inhibit expression of an XDH gene at position 2616 of the human XDH gene. (See, e.g., SEQ ID NO:1 and Table 2 for the XDH gene referenced).

The injections were performed between the skin and muscle (i.e. subcutaneous injections) into the loose skin over the neck and shoulder area. Four (4) rats in each group were tested (n=4). Rats were euthanized on study day 10, and total RNA was isolated from both livers following collection and homogenization. Rat XDH mRNA expression was quantitated by probe-based quantitative PCR, normalized to rat beta-actin expression, and expressed as fraction of vehicle control group (geometric mean, +/−95% confidence interval).

TABLE 24

| Average Relative Mouse XDH mRNA at Sacrifice (Day 10) in Example 11 | | | |
|---|---|---|---|
| Group ID | Average Relative rXDH mRNA | Low (error) | High (error) |
| Group 1 (No Treatment) | 1.000 | 0.164 | 0.197 |
| Group 2 (10.0 mg/kg AD09218) | 0.207 | 0.079 | 0.128 |
| Group 3 (3.0 mg/kg AD09218) | 0.295 | 0.105 | 0.163 |
| Group 4 (1.0 mg/kg AD09218) | 0.369 | 0.061 | 0.072 |
| Group 5 (0.3 mg/kg AD09218) | 0.556 | 0.086 | 0.102 |
| Group 6 (10.0 mg/kg AD09651) | 0.209 | 0.056 | 0.076 |
| Group 7 (3.0 mg/kg AD09651) | 0.271 | 0.045 | 0.054 |
| Group 8 (1.0 mg/kg AD09651) | 0.625 | 0.111 | 0.135 |
| Group 9 (0.3 mg/kg AD09651) | 0.828 | 0.114 | 0.132 |
| Group 10 (10.0 mg/kg AD09663) | 0.122 | 0.045 | 0.072 |
| Group 11 (3.0 mg/kg AD09663) | 0.213 | 0.060 | 0.083 |
| Group 12 (1.0 mg/kg AD09663) | 0.428 | 0.094 | 0.120 |
| Group 13 (0.3 mg/kg AD09663) | 0.481 | 0.112 | 0.146 |

The data were normalized to the non-treatment group (Group 1). As noted above in, for example, Example 3, the RNAi agent targeting position 488 of the XDH gene of Groups 2-5 (AD09218), while being previously identified as having activity in rats in vivo, includes a compromised nucleotide sequence and is unsuitable for therapeutic use due to toxicity concerns. As shown in Table 24, the XDH RNAi agent AD09651 (Groups 6-9), which targets position 2612 of the XDH gene transcript, and the XDH RNAi agent AD09663 (Groups 10-13), which targets position 2616, both showed dose-dependent mRNA reductions that were comparable to AD09218 (targeting position 488 of the XDH gene).

Example 12

In Vivo Testing of XDH RNAi Agents in Cynomolgus Monkeys

XDH RNAi agents AD09325 and AD09307 were evaluated in cynomolgus monkeys (cynos). On day 1, three male cynos for each group (n=3) were administered a subcutaneous injection of 0.3 mL/kg (approximately 1.5 mL volume, depending on animal mass) containing 3.0 mg/kg (10 mg/mL) of the respective XDH RNAi agent, formulated in isotonic saline.

TABLE 25

| Targeted Positions and Dosing Groups of Example 12 | | | |
|---|---|---|---|
| Group | Targeted Gene Position (within SEQ ID NO: 1) | RNAi Agent and Dose | Dosing Regimen (on day 1) |
| A | 3083 | 3.0 mg/kg AD09325 | Single subcutaneous injection |
| B | 4725 | 3.0 mg/kg AD09307 | Single subcutaneous injection |

The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agent in Groups A (AD09325) included nucleotide sequences that were designed to inhibit expression of a human XDH gene at position 3083; and the XDH RNAi agent in Group B (AD09307) included nucleotide sequences that were designed to inhibit expression of an XDH gene at position 4725. (See, e.g., SEQ ID NO:1 and Table 2 for the XDH gene referenced).

On days −8 (8 days before dose) and 15, survival liver biopsies were taken. On the date of each biopsy collection, cynos were anesthetized and laparoscopy was used to extract two liver tissue samples approximately 80 mg to 120 mg each, and aliquots of approximately 50 mg were snap-frozen and stored at −70° C. until analysis. On day 29, cynos were euthanized and aliquots of approximately 50 mg liver samples were collected. The biopsy samples were then homogenized, and levels of cyno XDH (cXDH) mRNA in the cyno livers were measured by RT-qPCR using a housekeeping gene as reference. Resulting values were then normalized to the pre-dose (in this case, at day −8) cXDH mRNA measurements. The resulting mRNA data are reflected in the following Table 26:

TABLE 26

Cyno XDH mRNA Levels Normalized to Pre-Dose (Day −8) from Example 12 for each Group (n = 3)

| | Day −8 | | | Day 15 | | |
|---|---|---|---|---|---|---|
| | Relative cXDH mRNA Expression | Low Error | High Error | Relative cXDH mRNA Expression | Low Error | High Error |
| Group A: AD09325 | 1.000 | 0.211 | 0.268 | 0.609 | 0.097 | 0.115 |
| Group B: AD09307 | 1.000 | 0.339 | 0.512 | 1.139 | 0.316 | 0.437 |

| | Day 29 | | |
|---|---|---|---|
| | Relative cXDH mRNA Expression | Low Error | High Error |
| Group A: AD09325 | 1.178 | 0.286 | 0.378 |
| Group B: AD09307 | 1.591 | 0.509 | 0.748 |

As shown in Table 26, XDH RNAi agent AD09325, which was designed to target position 3083 of the XDH gene, showed 39% inhibition of cXDH mRNA at Day 15 and returned to baseline by day 29. XDH RNAi agent AD09307, which was designed to target position 4725 of the XDH gene, showed no inhibitory activity at either of the time points measured.

Example 13

In Vivo Testing of XDH RNAi Agents in Cynomolgus Monkeys

XDH RNAi agents AD09734, AD09651, AD09663, and AD09611 were evaluated in cynomolgus monkeys (cynos). On days 1 and 31, three male cynos for each group (n=3) were administered a subcutaneous injection of 0.3 mL/kg (approximately 1.5 mL volume, depending on animal mass) containing 3.0 mg/kg (10 mg/mL) of the respective XDH RNAi agent, formulated in isotonic saline.

TABLE 27

| Targeted Positions and Dosing Groups of Example 13 | | | |
|---|---|---|---|
| Group | Targeted Gene Position (within SEQ ID NO: 1) | RNAi Agent and Dose | Dosing Regimen (on days 1 and 31) |
| 1 | 1322 | 3.0 mg/kg AD09734 | Two subcutaneous injections |
| 2 | 2612 | 3.0 mg/kg AD09651 | Two subcutaneous injections |
| 3 | 2616 | 3.0 mg/kg AD09663 | Two subcutaneous injections |
| 4 | 4289 | 3.0 mg/kg AD09611 | Two subcutaneous injections |

The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents included nucleotide sequences that were designed to inhibit expression of a human XDH gene at the specific positions as shown in Table 27, above. (See, e.g., SEQ ID NO:1 and Table 2 for the XDH gene referenced).

On days −14 or −7 (pre-dose), 15, 43, and 80 (for Group 4 only) liver biopsies were taken. On the date of each biopsy collection, cynos were anesthetized and laparoscopy was used to extract two liver tissue samples approximately 80 mg to 120 mg each, and aliquots of approximately 50 mg were snap-frozen and stored at −70° C. until analysis. The biopsy samples were then homogenized, and levels of cXDH mRNA in the cyno livers were measured by RT-qPCR using a housekeeping gene as reference. Resulting values were then normalized to the pre-dose (in this case, at day −14 or −7, depending on the animals) cXDH mRNA measurements. Batch analysis of samples across timepoints was performed where applicable. The resulting mRNA data are reflected in the following Table 28:

TABLE 28

| Cyno XDH mRNA Levels Normalized to Pre-Dose (Day −14 or −7) from Example 13 for each Group (n = 3) | | | | | | |
|---|---|---|---|---|---|---|
| | Pre-Dose (Day −14 or Day −7) | | | Day 15 | | |
| | Relative cXDH mRNA Expression | Low Error | High Error | Relative cXDH mRNA Expression | Low Error | High Error |
| Group 1: AD09734 | 1.000 | 0.127 | 0.145 | 0.351 | 0.028 | 0.031 |
| Group 2: AD09651 | 1.000 | 0.170 | 0.205 | 0.433 | 0.131 | 0.188 |
| Group 3: AD09663 | 1.000 | 0.374 | 0.597 | 0.621 | 0.274 | 0.489 |
| Group 4: AD09611 | 1.000 | 0.202 | 0.254 | 0.570 | 0.122 | 0.156 |

TABLE 28-continued

| Cyno XDH mRNA Levels Normalized to Pre-Dose (Day −14 or −7) from Example 13 for each Group (n = 3) | | | | | | |
|---|---|---|---|---|---|---|
| | Day 43 | | | Day 80 | | |
| | Relative cXDH mRNA Expression | Low Error | High Error | Relative cXDH mRNA Expression | Low Error | High Error |
| Group 1: AD09734 | 0.434 | 0.134 | 0.194 | | | |
| Group 2: AD09651 | 0.342 | 0.074 | 0.094 | | | |
| Group 3: AD09663 | 0.605 | 0.316 | 0.662 | | | |
| Group 4: AD09611 | 0.239 | 0.015 | 0.016 | 0.493 | 0.090 | 0.110 |

As shown in Table 28, each of the XDH RNAi agents showed inhibition of XDH gene expression.

XDH Activity Assay. Using RNAScope (see, e.g., RNA-scope, A Novel in Situ RNA Analysis Platform for Formalin-Fixed, Paraffin-Embedded Tissues, J Mol Diagn. 2012 January; 14(1): 22-29), it was determined that XDH mRNA transcripts are partitioned between both nuclear and cytosolic compartments. As translation to XDH protein only occurs in the cytoplasm, inhibition of cytoplasmic mRNA transcripts is considered therapeutically relevant. Measurement of XDH mRNA transcripts using q-PCR from whole liver homogenate, as explained in Table 28, is therefore not necessarily reflective of determining therapeutically relevant XDH inhibition as it measures the presence of XDH mRNA in both the cytosolic and nucleic compartments. Thus, to obtain a more accurate assessment of the inhibitory activity of the various XDH RNAi agents disclosed herein, an XDH activity assay was developed capable of indirectly measuring the amount of XDH protein inhibited by the XDH RNAi agents through the RNA interference mechanism.

More specifically, XDH activity was assessed using the following method: frozen cyno liver biopsy samples were homogenized in buffer containing 100 mM oxonic acid to inhibit endogenous uricase activity which is known to degrade uric acid. Liver homogenates were purified using Sephadex G25 spin columns, and protein concentrations adjusted to 0.5 μg/μl total protein (lysate). XDH activity was measured by liquid-chromatography mass spectrometry (LCMS) as the conversion of xanthine to uric acid at 37° C. within a 30-minute timeframe. The amount of uric acid generated over time is an indirect measure of the amount of cXDH protein present in the lysate; accordingly, the less uric acid identified, the less cXDH protein was present in lysate, thereby indicating a more potent XDH RNAi agent for reducing XDH protein. The resulting XDH activity data (normalized to pre-dose) are shown in Table 29.

TABLE 29

Cyno XDH Activity Levels Normalized to Pre-Dose (Day −14 or −7) from Example 13 for each Group (n = 3)

| | Pre-Dose (Day −14 or Day −7) | | Day 15 | | Day 43 | | Day 80 | |
|---|---|---|---|---|---|---|---|---|
| | Relative XDH Activity | Std Dev (+/−) | Relative XDH Activity | Std Dev (+/−) | Relative XDH Activity | Std Dev (+/−) | Relative XDH Activity | Std Dev (+/−) |
| Group 1: AD09734 | 1.000 | 0.042 | 0.363 | 0.056 | 0.240 | 0.056 | | |
| Group 2: AD09651 | 1.000 | 0.026 | 0.511 | 0.121 | 0.289 | 0.053 | | |
| Group 3: AD09663 | 1.000 | 0.003 | 0.412 | 0.219 | 0.247 | 0.164 | | |
| Group 4: AD09611 | 1.000 | 0.025 | 0.555 | 0.115 | 0.226 | 0.057 | 0.268 | 0.082 |

As shown in Table 29, through day 43 each of the RNAi agents tested above showed XDH activity reductions of greater than 70%. Further, RNAi agent AD09611 showed substantial reductions of XDH activity that were maintained for seven weeks post the last dose (day 31).

Example 14

In Vivo Testing of XDH RNAi Agents in XDH-GLuc AAV Mice

The XDH-GLUC AAV mouse model described in Example 2, above, using the XDH-GLuc AAV containing the 2820-5715 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 30.

TABLE 30

Targeted Positions and Dosing Groups of Example 14

| Group | Targeted Gene Position (within SEQ ID NO: 1) | RNAi Agent and Dose | Dosing Regimen |
|---|---|---|---|
| 1 | N/A | Saline (no RNAi agent) | Single injection on day 1 |
| 2 | 4289 | 2.0 mg/kg AD09611 | Single injection on day 1 |
| 3 | 4289 | 2.0 mg/kg AD10183 | Single injection on day 1 |
| 4 | 4289 | 2.0 mg/kg AD10629 | Single injection on day 1 |
| 5 | 4289 | 2.0 mg/kg AD10630 | Single injection on day 1 |

TABLE 30-continued

Targeted Positions and Dosing Groups of Example 14

| Group | Targeted Gene Position (within SEQ ID NO: 1) | RNAi Agent and Dose | Dosing Regimen |
|---|---|---|---|
| 6 | 4289 | 2.0 mg/kg AD10631 | Single injection on day 1 |
| 7 | 4289 | 2.0 mg/kg AD10632 | Single injection on day 1 |
| 8 | 4289 | 2.0 mg/kg AD10184 | Single injection on day 1 |
| 9 | 4289 | 2.0 mg/kg AD10633 | Single injection on day 1 |
| 10 | 4289 | 2.0 mg/kg AD10634 | Single injection on day 1 |
| 11 | 4289 | 2.0 mg/kg AD10635 | Single injection on day 1 |
| 12 | 4289 | 2.0 mg/kg AD10636 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-12 each included nucleotide sequences that were designed to inhibit expression of an XDH gene at position 4289 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, and day 15, and XDH expression levels were determined pursuant to the procedure set forth in Example 2, above. Data from the experiment through day 22 are shown in Table 31:

TABLE 31

Average XDH Normalized to Pre-Treatment & Control in XDH-GLUC AAV Mice from Example 14

| | Day 8 | | Day 15 | | Day 22 | |
|---|---|---|---|---|---|---|
| Group ID | Avg XDH | Std Dev (+/−) | Avg XDH | Std Dev (+/−) | Avg XDH | Std Dev (+/−) |
| Group 1 (Saline vehicle) | 1.000 | 0.164 | 1.000 | 0.044 | 1.000 | 0.085 |
| Group 2 (2.0 mg/kg AD09611) | 0.877 | 0.113 | 0.710 | 0.100 | 0.629 | 0.148 |
| Group 3 (2.0 mg/kg AD10183) | 0.585 | 0.084 | 0.402 | 0.082 | 0.432 | 0.098 |
| Group 4 (2.0 mg/kg AD10629) | 0.548 | 0.119 | 0.443 | 0.127 | 0.501 | 0.195 |
| Group 5 (2.0 mg/kg AD10630) | 0.708 | 0.076 | 0.609 | 0.130 | 0.497 | 0.045 |
| Group 6 (2.0 mg/kg AD10631) | 0.523 | 0.035 | 0.398 | 0.090 | 0.477 | 0.080 |

TABLE 31-continued

| Average XDH Normalized to Pre-Treatment & Control in XDH-GLUC AAV Mice from Example 14 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 7 (2.0 mg/kg AD10632) | 0.679 | 0.248 | 0.583 | 0.125 | 0.574 | 0.314 |
| Group 8 (2.0 mg/kg AD10184) | 0.573 | 0.051 | 0.501 | 0.029 | 0.529 | 0.070 |
| Group 9 (2.0 mg/kg AD10633) | 0.686 | 0.153 | 0.544 | 0.080 | 0.562 | 0.111 |
| Group 10 (2.0 mg/kg AD10634) | 0.680 | 0.136 | 0.572 | 0.088 | 0.615 | 0.092 |
| Group 11 (2.0 mg/kg AD10635) | 0.764 | 0.178 | 0.678 | 0.105 | 0.674 | 0.083 |
| Group 12 (2.0 mg/kg AD10636) | 0.555 | 0.068 | 0.440 | 0.091 | 0.488 | 0.126 |

Example 15

In Vivo Testing of XDH RNAi Agents in XDH-GLuc AAV Mice

The XDH-GLUC AAV mouse model described in Example 2, using the XDH-GLuc AAV containing the 80-2899 region of the human XDH cDNA sequence was used. At day 1, each mouse was given a single subcutaneous administration of 250 μl/25 g animal weight containing either 1.0 mg/kg (mpk) or 3.0 mg/kg (mpk) of an XDH RNAi agent formulated in isotonic saline, or vehicle control (isotonic saline with no RNAi agent), according to Table 32.

TABLE 32

| Targeted Positions and Dosing Groups of Example 15 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 1963 | 3.0 mg/kg AD09736 | Single injection on day 1 |
| 3 | 1963 | 1.0 mg/kg AD09736 | Single injection on day 1 |
| 4 | 1963 | 3.0 mg/kg AD09937 | Single injection on day 1 |
| 5 | 1963 | 1.0 mg/kg AD09937 | Single injection on day 1 |
| 6 | 1963 | 3.0 mg/kg AD09967 | Single injection on day 1 |
| 7 | 1963 | 1.0 mg/kg AD09967 | Single injection on day 1 |
| 8 | 1963 | 3.0 mg/kg AD10278 | Single injection on day 1 |
| 9 | 1963 | 1.0 mg/kg AD10278 | Single injection on day 1 |
| 10 | 1963 | 3.0 mg/kg AD10281 | Single injection on day 1 |
| 11 | 1963 | 1.0 mg/kg AD10281 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents of Groups 2-11 all included nucleotide sequences that were designed to inhibit expression of an XDH gene at position 1963 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, and day 22, and XDH expression levels were determined pursuant to the procedure set forth in Example 2, above. Data from the experiment through day 22 are shown in Table 33:

TABLE 33

| Average XDH Normalized to Pre-Treatment & Control in XDH-GLUC AAV Mice from Example 15 | | | | |
|---|---|---|---|---|
| | Day 8 | | Day 22 | |
| Group ID | Avg XDH | Std Dev (+/−) | Avg XDH | Std Dev (+/−) |
| Group 1 (Saline vehicle) | 1.000 | 0.202 | 1.000 | 0.112 |
| Group 2 (3.0 mg/kg AD09736) | 0.587 | 0.080 | 0.682 | 0.182 |
| Group 3 (1.0 mg/kg AD09736) | 1.100 | 0.292 | 1.063 | 0.212 |
| Group 4 (3.0 mg/kg AD09937) | 0.554 | 0.211 | 0.547 | 0.214 |
| Group 5 (1.0 mg/kg AD09937) | 0.914 | 0.175 | 0.851 | 0.175 |
| Group 6 (3.0 mg/kg AD09967) | 0.638 | 0.035 | 0.696 | 0.139 |
| Group 7 (1.0 mg/kg AD09967) | 0.838 | 0.103 | 0.790 | 0.149 |
| Group 8 (3.0 mg/kg AD10278) | 0.518 | 0.036 | 0.678 | 0.112 |
| Group 9 (1.0 mg/kg AD10278) | 1.209 | 0.116 | 0.940 | 0.266 |
| Group 10 (3.0 mg/kg AD10281) | 0.769 | 0.184 | 0.762 | 0.145 |
| Group 11 (1.0 mg/kg AD10281) | 1.224 | 0.172 | 0.995 | 0.160 |

Example 16

In Vivo Testing of XDH RNAi Agents in XDH-GLuc AAV Mice

The XDH-GLUC AAV mouse model described in Example 2, above, using the XDH-GLuc AAV containing the 2820-5715 region of the human XDH cDNA sequence was used. At day 1, each mouse was given a single subcutaneous administration of 250 μl/25 g animal weight containing either 4.0 mg/kg (mpk), 2.0 mg/kg (mpk), 1.0 mg/kg (mpk) of an XDH RNAi agent formulated in isotonic saline, or vehicle control (isotonic saline with no RNAi agent), according to Table 34.

TABLE 34

| Targeted Positions and Dosing Groups of Example 16 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 4289 | 4.0 mg/kg AD09611 | Single injection on day 1 |
| 3 | 4289 | 2.0 mg/kg AD09611 | Single injection on day 1 |
| 4 | 4289 | 1.0 mg/kg AD09611 | Single injection on day 1 |
| 5 | 4289 | 4.0 mg/kg AD10183 | Single injection on day 1 |
| 6 | 4289 | 2.0 mg/kg AD10183 | Single injection on day 1 |
| 7 | 4289 | 1.0 mg/kg AD10183 | Single injection on day 1 |
| 8 | 4289 | 4.0 mg/kg AD10631 | Single injection on day 1 |
| 9 | 4289 | 2.0 mg/kg AD10631 | Single injection on day 1 |
| 10 | 4289 | 1.0 mg/kg AD10631 | Single injection on day 1 |
| 11 | 4289 | 4.0 mg/kg AD10184 | Single injection on day 1 |

TABLE 34-continued

| Targeted Positions and Dosing Groups of Example 16 | | | |
|---|---|---|---|
| Group | Targeted Gene Position (within SEQ ID NO: 1) | RNAi Agent and Dose | Dosing Regimen |
| 12 | 4289 | 2.0 mg/kg AD10184 | Single injection on day 1 |
| 13 | 4289 | 1.0 mg/kg AD10184 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-13 each included nucleotide sequences that were designed to inhibit expression of an XDH gene at position 4289 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2. Data from the experiment through day 22 are shown in Table 35:

TABLE 35

Average XDH Normalized to Pre-Treatment & Control in XDH-GLUC AAV Mice from Example 16

| Group ID | Day 8 Avg XDH | Day 8 Std Dev (+/−) | Day 15 Avg XDH | Day 15 Std Dev (+/−) | Day 22 Avg XDH | Day 22 Std Dev (+/−) |
|---|---|---|---|---|---|---|
| Group 1 (Saline vehicle) | 1.000 | 0.167 | 1.000 | 0.099 | 1.000 | 0.048 |
| Group 2 (4.0 mg/kg AD09611) | 0.808 | 0.086 | 0.810 | 0.089 | 0.958 | 0.118 |
| Group 3 (2.0 mg/kg AD09611) | 1.100 | 0.224 | 0.998 | 0.383 | 1.245 | 0.476 |
| Group 4 (1.0 mg/kg AD09611) | 0.917 | 0.198 | 0.941 | 0.224 | 0.780 | 0.544 |
| Group 5 (4.0 mg/kg AD10183) | 0.636 | 0.140 | 0.642 | 0.044 | 0.797 | 0.112 |
| Group 6 (2.0 mg/kg AD10183) | 0.768 | 0.059 | 0.672 | 0.206 | 0.870 | 0.079 |
| Group 7 (1.0 mg/kg AD10183) | 0.841 | 0.111 | 0.792 | 0.266 | 0.938 | 0.122 |
| Group 8 (4.0 mg/kg AD10631) | 0.755 | 0.110 | 0.677 | 0.094 | 0.664 | 0.126 |
| Group 9 (2.0 mg/kg AD10631) | 0.852 | 0.066 | 0.755 | 0.103 | 0.869 | 0.149 |
| Group 10 (1.0 mg/kg AD10631) | 0.884 | 0.153 | 0.954 | 0.128 | 1.060 | 0.071 |
| Group 11 (4.0 mg/kg AD10184) | 0.640 | 0.079 | 0.663 | 0.055 | 0.680 | 0.068 |
| Group 12 (2.0 mg/kg AD10184) | 0.729 | 0.049 | 0.746 | 0.126 | 0.811 | 0.116 |
| Group 13 (1.0 mg/kg AD10184) | 0.807 | 0.069 | 0.730 | 0.090 | 0.796 | 0.119 |

Example 17

In Vivo Testing of XDH RNAi Agents in XDH-GLuc AAV Mice

The XDH-GLUC AAV mouse model described in Example 2, using the XDH-GLuc AAV containing the 2820-5715 region of the human XDH cDNA sequence was used. At day 1, each mouse was given a single subcutaneous administration of 200 μl/20 g animal weight containing either 4.0 mg/kg (mpk), 2.0 mg/kg (mpk), 1.0 mg/kg (mpk) of an XDH RNAi agent formulated in isotonic saline, or vehicle control (isotonic saline with no RNAi agent), according to Table 36.

TABLE 36

| Targeted Positions and Dosing Groups of Example 17 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 3598 | 4.0 mg/kg AD09985 | Single injection on day 1 |
| 3 | 3598 | 2.0 mg/kg AD09985 | Single injection on day 1 |
| 4 | 3598 | 1.0 mg/kg AD09985 | Single injection on day 1 |
| 5 | 3598 | 4.0 mg/kg AD10729 | Single injection on day 1 |
| 6 | 3598 | 2.0 mg/kg AD10729 | Single injection on day 1 |
| 7 | 3598 | 1.0 mg/kg AD10729 | Single injection on day 1 |
| 8 | 3598 | 4.0 mg/kg AD10730 | Single injection on day 1 |
| 9 | 3598 | 2.0 mg/kg AD10730 | Single injection on day 1 |
| 10 | 3598 | 1.0 mg/kg AD10730 | Single injection on day 1 |
| 11 | 3598 | 4.0 mg/kg AD10734 | Single injection on day 1 |
| 12 | 3598 | 2.0 mg/kg AD10734 | Single injection on day 1 |
| 13 | 3598 | 1.0 mg/kg AD10734 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-13 each included nucleotide sequences that were designed to inhibit expression of an XDH gene at position 3598 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2, above. Data from the experiment through day 22 are shown in Table 37:

TABLE 37

| Average XDH Normalized to Pre-Treatment & Control in XDH-GLUC AAV Mice from Example 17 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.294 | 1.000 | 0.350 | 1.000 | 0.156 |
| Group 2 (4.0 mg/kg AD09985) | 0.342 | 0.061 | 0.340 | 0.052 | 0.320 | 0.074 |
| Group 3 (2.0 mg/kg AD09985) | 0.464 | 0.065 | 0.443 | 0.076 | 0.457 | 0.108 |
| Group 4 (1.0 mg/kg AD09985) | 0.527 | 0.163 | 0.509 | 0.075 | 0.487 | 0.094 |
| Group 5 (4.0 mg/kg AD10729) | 0.393 | 0.081 | 0.379 | 0.074 | 0.359 | 0.045 |
| Group 6 (2.0 mg/kg AD10729) | 0.504 | 0.176 | 0.447 | 0.132 | 0.394 | 0.176 |
| Group 7 (1.0 mg/kg AD10729) | 0.480 | 0.168 | 0.535 | 0.279 | 0.486 | 0.205 |
| Group 8 (4.0 mg/kg AD10730) | 0.322 | 0.035 | 0.316 | 0.046 | 0.244 | 0.064 |
| Group 9 (2.0 mg/kg AD10730) | 0.467 | 0.076 | 0.397 | 0.052 | 0.360 | 0.113 |
| Group 10 (1.0 mg/kg AD10730) | 0.560 | 0.114 | 0.540 | 0.079 | 0.536 | 0.068 |
| Group 11 (4.0 mg/kg AD10734) | 0.369 | 0.048 | 0.340 | 0.074 | 0.278 | 0.025 |
| Group 12 (2.0 mg/kg AD10734) | 0.574 | 0.338 | 0.467 | 0.255 | 0.432 | 0.299 |
| Group 13 (1.0 mg/kg AD10734) | 0.616 | 0.198 | 0.617 | 0.086 | 0.389 | 0.076 |

Example 18

In Vivo Testing of XDH RNAi Agents in XDH-GLuc AAV Mice

The XDH-GLUC AAV mouse model described in Example 2, using the XDH-GLuc AAV containing the 80-2899 and 2820-5715 regions of the human XDH cDNA sequence was used. At day 1, each mouse was given a single subcutaneous administration of 200 μl/20 g animal weight containing either 4.0 mg/kg (mpk), 2.0 mg/kg (mpk), 1.0 mg/kg (mpk) of an XDH RNAi agent formulated in isotonic saline, or vehicle control (isotonic saline with no RNAi agent), according to Table 38.

TABLE 38

| Targeted Positions and Dosing Groups of Example 18 | | | |
|---|---|---|---|
| Group | Targeted Gene Position (within SEQ ID NO: 1) | RNAi Agent and Dose | Dosing Regimen |
| 1 | 2696 | Saline (no RNAi agent) | Single injection on day 1 |
| 2 | 2696 | 4.0 mg/kg AD09744 | Single injection on day 1 |
| 3 | 2696 | 2.0 mg/kg AD09744 | Single injection on day 1 |
| 4 | 2696 | 1.0 mg/kg AD09744 | Single injection on day 1 |
| 5 | 2696 | 4.0 mg/kg AD10621 | Single injection on day 1 |
| 6 | 2696 | 2.0 mg/kg AD10621 | Single injection on day 1 |
| 7 | 2696 | 1.0 mg/kg AD10621 | Single injection on day 1 |
| 8 | 1963 | 4.0 mg/kg AD09736 | Single injection on day 1 |
| 9 | 1963 | 2.0 mg/kg AD09736 | Single injection on day 1 |

TABLE 38-continued

| Targeted Positions and Dosing Groups of Example 18 | | | |
|---|---|---|---|
| Group | Targeted Gene Position (within SEQ ID NO: 1) | RNAi Agent and Dose | Dosing Regimen |
| 10 | 1963 | 1.0 mg/kg AD09736 | Single injection on day 1 |
| 11 | 1963 | 4.0 mg/kg AD09937 | Single injection on day 1 |
| 12 | 1963 | 2.0 mg/kg AD09937 | Single injection on day 1 |
| 13 | 1963 | 1.0 mg/kg AD09937 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-13 each included nucleotide sequences that were designed to inhibit expression of an XDH gene at positions 2696 and 1963 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2. Data from the experiment through day 22 are shown in Table 39:

TABLE 39A

| Average XDH Normalized to Pre-Treatment in XDH-GLUC AAV Mice from Example 18 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.183 | 0.346 | 1.164 | 0.468 | 1.448 | 0.573 |
| Group 2 (4.0 mg/kg AD09744) | 0.538 | 0.113 | 0.404 | 0.106 | 0.601 | 0.062 |
| Group 3 (2.0 mg/kg AD09744) | 0.704 | 0.210 | 0.663 | 0.165 | 0.950 | 0.214 |
| Group 4 (1.0 mg/kg AD09744) | 0.903 | 0.100 | 0.842 | 0.154 | 1.101 | 0.249 |
| Group 5 (4.0 mg/kg AD10621) | 0.406 | 0.226 | 0.366 | 0.293 | 0.650 | 0.532 |
| Group 6 (2.0 mg/kg AD10621) | 0.521 | 0.261 | 0.411 | 0.225 | 0.640 | 0.343 |

TABLE 39A-continued

| Average XDH Normalized to Pre-Treatment in XDH-GLUC AAV Mice from Example 18 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 7 (1.0 mg/kg AD10621) | 0.580 | 0.202 | 0.467 | 0.227 | 0.669 | 0.361 |
| Group 8 (4.0 mg/kg AD09736) | 0.870 | 0.117 | 0.732 | 0.045 | 1.084 | 0.195 |
| Group 9 (2.0 mg/kg AD09736) | 0.867 | 0.088 | 0.809 | 0.100 | 1.187 | 0.254 |
| Group 10 (1.0 mg/kg AD09736) | 1.313 | 0.177 | 1.199 | 0.185 | 1.344 | 0.185 |
| Group 11 (4.0 mg/kg AD09937) | 0.540 | 0.164 | 0.588 | 0.268 | 0.780 | 0.247 |
| Group 12 (2.0 mg/kg AD09937) | 0.636 | 0.249 | 0.812 | 0.480 | 0.846 | 0.312 |
| Group 13 (1.0 mg/kg AD09937) | 0.927 | 0.215 | 0.932 | 0.127 | 1.011 | 0.057 |

TABLE 39B

| Average XDH Normalized to Pre-Treatment & Control in XDH-GLUC AAV Mice from Example 18 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.292 | 1.000 | 0.403 | 1.000 | 0.396 |
| Group 2 (4.0 mg/kg AD09744) | 0.455 | 0.095 | 0.347 | 0.091 | 0.415 | 0.043 |
| Group 3 (2.0 mg/kg AD09744) | 0.595 | 0.178 | 0.570 | 0.142 | 0.656 | 0.147 |
| Group 4 (1.0 mg/kg AD09744) | 0.763 | 0.084 | 0.724 | 0.132 | 0.760 | 0.172 |
| Group 5 (4.0 mg/kg AD10621) | 0.343 | 0.191 | 0.315 | 0.252 | 0.449 | 0.367 |
| Group 6 (2.0 mg/kg AD10621) | 0.441 | 0.220 | 0.353 | 0.193 | 0.442 | 0.237 |
| Group 7 (1.0 mg/kg AD10621) | 0.491 | 0.171 | 0.402 | 0.195 | 0.462 | 0.249 |
| Group 8 (4.0 mg/kg AD09736) | 0.736 | 0.099 | 0.629 | 0.039 | 0.748 | 0.135 |
| Group 9 (2.0 mg/kg AD09736) | 0.733 | 0.075 | 0.696 | 0.086 | 0.820 | 0.175 |
| Group 10 (1.0 mg/kg AD09736) | 1.110 | 0.150 | 1.031 | 0.159 | 0.928 | 0.128 |
| Group 11 (4.0 mg/kg AD09937) | 0.457 | 0.139 | 0.505 | 0.230 | 0.538 | 0.171 |
| Group 12 (2.0 mg/kg AD09937) | 0.538 | 0.210 | 0.698 | 0.413 | 0.584 | 0.216 |
| Group 13 (1.0 mg/kg AD09937) | 0.783 | 0.182 | 0.801 | 0.109 | 0.698 | 0.039 |

Example 19

In Vivo Testing of XDH RNAi Agents in XDH-GLuc AAV Mice

The XDH-GLUC AAV mouse model described in Example 2, using the XDH-GLuc AAV containing the 80-2899 region of the human XDH cDNA sequence was used. At day 1, each mouse was given a single subcutaneous administration of 200 μl/20 g animal weight containing either 4.0 mg/kg (mpk), 2.0 mg/kg (mpk) of an XDH RNAi agent formulated in isotonic saline, or vehicle control (isotonic saline with no RNAi agent), according to Table 40.

TABLE 40

| Targeted Positions and Dosing Groups of Example 19 | | | |
|---|---|---|---|
| Group | Targeted Gene Position (within SEQ ID NO: 1) | RNAi Agent and Dose | Dosing Regimen |
| 1 | 1963 | Saline (no RNAi agent) | Single injection on day 1 |
| 2 | 1963 | 4.0 mg/kg AD09736 | Single injection on day 1 |
| 3 | 1963 | 2.0 mg/kg AD09736 | Single injection on day 1 |
| 4 | 1963 | 4.0 mg/kg AD10967 | Single injection on day 1 |
| 5 | 1963 | 2.0 mg/kg AD10967 | Single injection on day 1 |
| 6 | 1963 | 4.0 mg/kg AD10968 | Single injection on day 1 |
| 7 | 1963 | 2.0 mg/kg AD10968 | Single injection on day 1 |

TABLE 40-continued

| Targeted Positions and Dosing Groups of Example 19 | | | |
|---|---|---|---|
| Group | Targeted Gene Position (within SEQ ID NO: 1) | RNAi Agent and Dose | Dosing Regimen |
| 8 | 1963 | 4.0 mg/kg AD10969 | Single injection on day 1 |
| 9 | 1963 | 2.0 mg/kg AD10969 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-9 each included nucleotide sequences that were designed to inhibit expression of an XDH gene at position 1963 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2. Data from the experiment through day 22 are shown in Table 41:

TABLE 41

| Average XDH Normalized to Pre-Treatment & Control in XDH-GLUC AAV Mice from Example 19 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.158 | 1.000 | 0.166 | 1.000 | 0.077 |
| Group 2 (4.0 mg/kg AD09736) | 0.607 | 0.088 | 0.704 | 0.077 | 0.635 | 0.230 |
| Group 3 (2.0 mg/kg AD09736) | 0.738 | 0.199 | 0.742 | 0.085 | 0.991 | 0.061 |
| Group 4 (4.0 mg/kg AD10967) | 0.468 | 0.115 | 0.542 | 0.083 | 0.714 | 0.131 |
| Group 5 (2.0 mg/kg AD10967) | 0.746 | 0.099 | 0.826 | 0.047 | 0.940 | 0.203 |
| Group 6 (4.0 mg/kg AD10968) | 0.520 | 0.131 | 0.488 | 0.149 | 0.685 | 0.176 |
| Group 7 (2.0 mg/kg AD10968) | 0.534 | 0.148 | 0.597 | 0.135 | 0.827 | 0.155 |
| Group 8 (4.0 mg/kg AD10969) | 0.614 | 0.194 | 0.617 | 0.211 | 0.758 | 0.264 |
| Group 9 (2.0 mg/kg AD10969) | 0.728 | 0.274 | 0.711 | 0.244 | 0.984 | 0.440 |

Example 20

In Vivo Testing of XDH RNAi Agents in XDH-GLuc AAV Mice

The XDH-GLUC AAV mouse model described in Example 2, using the XDH-GLuc AAV containing the 2820-5715 region of the human XDH cDNA sequence was used. At day 1, each mouse was given a single subcutaneous administration of 200 μl/20 g animal weight containing either 4.0 mg/kg (mpk), 2.0 mg/kg (mpk), 1.0 mg/kg (mpk) of an XDH RNAi agent formulated in isotonic saline, or vehicle control (isotonic saline with no RNAi agent), according to Table 42.

TABLE 42

| Targeted Positions and Dosing Groups of Example 20 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 4289 | 4.0 mg/kg AD09611 | Single injection on day 1 |
| 3 | 4289 | 2.0 mg/kg AD09611 | Single injection on day 1 |
| 4 | 4289 | 1.0 mg/kg AD09611 | Single injection on day 1 |
| 5 | 4289 | 4.0 mg/kg AD10631 | Single injection on day 1 |
| 6 | 4289 | 2.0 mg/kg AD10631 | Single injection on day 1 |
| 7 | 4289 | 1.0 mg/kg AD10631 | Single injection on day 1 |
| 8 | 3598 | 4.0 mg/kg AD09985 | Single injection on day 1 |

TABLE 42-continued

| Targeted Positions and Dosing Groups of Example 20 | | | |
|---|---|---|---|
| Group | Targeted Gene Position (within SEQ ID NO: 1) | RNAi Agent and Dose | Dosing Regimen |
| 9 | 3598 | 2.0 mg/kg AD09985 | Single injection on day 1 |
| 10 | 3598 | 1.0 mg/kg AD09985 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-10 each included nucleotide sequences that were designed to inhibit expression of an XDH gene at positions 4289 and 3598 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2. Data from the experiment through day 22 are shown in Table 43:

TABLE 43

| Average XDH Normalized to Pre-Treatment & Control in XDH-GLUC AAV Mice from Example 20 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.209 | 1.000 | 0.098 | 1.000 | 0.222 |
| Group 2 (4.0 mg/kg AD09611) | 0.892 | 0.047 | 0.777 | 0.181 | 0.829 | 0.213 |
| Group 3 (2.0 mg/kg AD09611) | 0.703 | 0.168 | 0.699 | 0.159 | 0.789 | 0.209 |
| Group 4 (1.0 mg/kg AD09611) | 0.868 | 0.183 | 0.843 | 0.071 | 0.729 | 0.136 |
| Group 5 (4.0 mg/kg AD10631) | 0.642 | 0.082 | 0.651 | 0.058 | 0.644 | 0.153 |
| Group 6 (2.0 mg/kg AD10631) | 0.660 | 0.192 | 0.594 | 0.082 | 0.557 | 0.102 |
| Group 7 (1.0 mg/kg AD10631) | 0.626 | 0.060 | 0.649 | 0.089 | 0.720 | 0.143 |
| Group 8 (4.0 mg/kg AD09985) | 0.600 | 0.360 | 0.600 | 0.341 | 0.586 | 0.209 |
| Group 9 (2.0 mg/kg AD09985) | 0.576 | 0.119 | 0.519 | 0.025 | 0.619 | 0.088 |
| Group 10 (1.0 mg/kg AD09985) | 0.710 | 0.163 | 0.641 | 0.086 | 0.631 | 0.136 |

Example 21

In Vivo Testing of XDH RNAi Agents in Cynomolgus Monkeys

XDH RNAi agent AD09611, which was previously evaluated in cynomolgus monkeys (cynos) in the study described in Example 13, was further evaluated in cynomolgus monkeys (cynos). On days 1, 15, and 29, three male cynos for each group (n=3) were administered a subcutaneous injection of 0.3 mL/kg (approximately 1.5 mL volume, depending on animal mass) containing 3.0 mg/kg (10 mg/mL) of the respective XDH RNAi agent, formulated in isotonic saline.

TABLE 44

Targeted Positions and Dosing Groups of Example 21

| Group | Targeted Gene Position (within SEQ ID NO: 1) | RNAi Agent and Dose | Dosing Regimen (on days 1, 15, and 29) |
|---|---|---|---|
| 1 | 4289 | 3.0 mg/kg AD09611 | Three subcutaneous injections |
| 2 | 4289 | 3.0 mg/kg AD09611 | Three subcutaneous injections |

The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents included nucleotide sequences that were designed to inhibit expression of a human XDH gene at the specific positions as shown in Table 43, above. (See, e.g., SEQ ID NO:1 and Table 2 for the XDH gene referenced).

On days −14, 29, 57, and 85, liver biopsies were taken from Group 1 animals. On days −7, 43, 71, and 99, liver biopsies were taken from Group 2 animals. On the date of each biopsy collection, cynos were sedated and Menghini technique was used to extract two liver tissue samples, and aliquots of approximately 10 mg were snap-frozen and stored at −70° C. until analysis. The biopsy samples were then homogenized, and levels of cXDH mRNA in the cyno livers were measured by RT-qPCR using a housekeeping gene as reference. Resulting values were then normalized to the pre-dose (in this case, at day −14 or −7, depending on the animals) cXDH mRNA measurements. The resulting mRNA data are reflected in the following Table 45:

TABLE 45

Cyno XDH mRNA Levels Normalized to Pre-Dose (Day −14 or −7) from Example 21 for each Group (n = 3)

| | Pre-Dose (Day −14 or Day −7) | | | Day 29 | | |
|---|---|---|---|---|---|---|
| | Relative cXDH mRNA Expression | Low Error | High Error | Relative cXDH mRNA Expression | Low Error | High Error |
| Group 1: AD09611 | 1.000 | 0.177 | 0.215 | 0.595 | 0.097 | 0.116 |
| Group 2: AD09611 | 1.000 | 0.083 | 0.091 | NA | NA | NA |

| | Day 43 | | | Day 57 | | |
|---|---|---|---|---|---|---|
| | Relative cXDH mRNA Expression | Low Error | High Error | Relative cXDH mRNA Expression | Low Error | High Error |
| Group 1: AD09611 | | | | 0.429 | 0.105 | 0.138 |
| Group 2: AD09611 | 0.604 | 0.060 | 0.067 | | | |

| | Day 71 | | | Day 85 | | |
|---|---|---|---|---|---|---|
| | Relative cXDH mRNA Expression | Low Error | High Error | Relative cXDH mRNA Expression | Low Error | High Error |
| Group 1: AD09611 | | | | 0.560 | 0.079 | 0.092 |
| Group 2: AD09611 | 0.758 | 0.121 | 0.144 | | | |

| | Day 99 | | |
|---|---|---|---|
| | Relative cXDH mRNA Expression | Low Error | High Error |
| Group 1: AD09611 | | | |
| Group 2: AD09611 | 0.950 | 0.066 | 0.071 |

Additionally, XDH activity was assessed using the XDH Activity Assay method described in Example 13. The resulting XDH activity data are shown in Table 46.

TABLE 46

Cyno XDH Activity Levels Normalized to Pre-Dose (Day −14 or −7) from Example 21 for each Group (n = 3)

| | Pre-Dose (Day −14 or Day −7) | | Day 29 | | Day 43 | | Day 57 | |
|---|---|---|---|---|---|---|---|---|
| | Relative XDH Activity | Std Dev (+/−) | Relative XDH Activity | Std Dev (+/−) | Relative XDH Activity | Std Dev (+/−) | Relative XDH Activity | Std Dev (+/−) |
| Group 1: AD09611 | 1.000 | 0.01 | 0.290 | 0.004 | | | 0.391 | 0.15 |
| Group 2: AD09611 | 1.000 | 0.012 | | | 0.394 | 0.066 | | |

| | Day 71 | | Day 85 | | Day 99 | |
|---|---|---|---|---|---|---|
| | Relative XDH Activity | Std Dev (+/−) | Relative XDH Activity | Std Dev (+/−) | Relative XDH Activity | Std Dev (+/−) |
| Group 1: AD09611 | | | 0.341 | 0.079 | | |
| Group 2: AD09611 | 0.357 | 0.098 | | | 0.465 | 0.067 |

As shown in Table 46, AD09611 showed XDH activity reductions of up to 70% as measured on day 29, and reductions were maintained at greater than 50% through day 99.

Example 22

In Vivo Testing of XDH RNAi Agents in Cynomolgus Monkeys

XDH RNAi agents AD10631, AD09736, AD10621, and AD09985 were evaluated in cynomolgus monkeys (cynos). On days 1, 15, and 29, three male cynos for each group (n=3) were administered a subcutaneous injection of 0.3 mL/kg (approximately 1.5 mL volume, depending on animal mass) containing 3.0 mg/kg (10 mg/mL) of the respective XDH RNAi agent, formulated in isotonic saline.

TABLE 47

Targeted Positions and Dosing Groups of Example 22

| Group | Targeted Gene Position (within SEQ ID NO: 1) | RNAi Agent and Dose | Dosing Regimen (on days 1, 15, and 29) |
|---|---|---|---|
| 1 | 4289 | 3.0 mg/kg AD10631 | Three subcutaneous injections |
| 2 | 1963 | 3.0 mg/kg AD09736 | Three subcutaneous injections |
| 3 | 2696 | 3.0 mg/kg AD10621 | Three subcutaneous injections |
| 4 | 3598 | 3.0 mg/kg AD09985 | Three subcutaneous injections |

The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents included nucleotide sequences that were designed to inhibit expression of a human XDH gene at the specific positions as shown in Table 47. (See, e.g., SEQ ID NO:1 and Table 2 for the XDH gene referenced). As noted herein, AD10631 was designed to target position 4289 and was comprised of a chemically modified nucleotide sequence similar to AD09611, but included a 5'-cyclopropyl-phosphonate modified nucleotide at the 5' terminal end of the antisense strand.

On days −7, 43, 71, and 99, liver biopsies were taken. On the date of each biopsy collection, cynos were sedated and 3.5 mm×310 mm clamshell biopsy forceps were used to extract one liver tissue sample approximately 160 mg to 240 mg, and aliquots of approximately 50 mg were snap-frozen and stored at −70° C. until analysis. The biopsy samples were then homogenized, and levels of cXDH mRNA in the cyno livers were measured by RT-qPCR using a housekeeping gene as reference. Resulting values were then normalized to the pre-dose (in this case, at day −7) cXDH mRNA measurements. The resulting mRNA data are reflected in Table 48:

TABLE 48

Cyno XDH mRNA Levels Normalized to Pre-Dose (Day −7) from Example 22 for each Group (n = 3)

| | Pre-Dose (Day −7) | | | Day 43 | | |
|---|---|---|---|---|---|---|
| | Relative cXDH mRNA Expression | Low Error | High Error | Relative cXDH mRNA Expression | Low Error | High Error |
| Group 1: AD10631 | 1.000 | 0.093 | 0.102 | 0.459 | 0.062 | 0.072 |
| Group 2: AD09736 | 1.000 | 0.120 | 0.136 | 0.420 | 0.076 | 0.092 |
| Group 3: AD10621 | 1.000 | 0.113 | 0.127 | 0.373 | 0.025 | 0.027 |
| Group 4: AD09985 | 1.000 | 0.084 | 0.091 | 0.413 | 0.081 | 0.101 |

TABLE 48-continued

| Cyno XDH mRNA Levels Normalized to Pre-Dose (Day −7) from Example 22 for each Group (n = 3) | | | | | | |
|---|---|---|---|---|---|---|
| | Day 71 | | | Day 99 | | |
| | Relative cXDH mRNA Expression | Low Error | High Error | Relative cXDH mRNA Expression | Low Error | High Error |
| Group 1: AD10631 | 0.413 | 0.036 | 0.040 | 0.595 | 0.055 | 0.060 |
| Group 2: AD09736 | 0.478 | 0.072 | 0.085 | 0.502 | 0.126 | 0.168 |
| Group 3: AD10621 | 0.397 | 0.029 | 0.031 | 0.477 | 0.038 | 0.042 |
| Group 4: AD09985 | 0.339 | 0.047 | 0.055 | 0.459 | 0.107 | 0.140 |

Additionally, XDH activity was assessed using the XDH Activity Assay method described in Example 13. The resulting XDH activity data are shown in Table 49.

TABLE 49

| Cyno XDH Activity Levels Normalized to Pre-Dose (Day −7) from Example 22 for each Group (n = 3) | | | | | | | | |
|---|---|---|---|---|---|---|---|---|
| | Pre-Dose (Day −7) | | Day 43 | | Day 71 | | Day 98 | |
| | Relative XDH Activity | Std Dev (+/−) | Relative XDH Activity | Std Dev (+/−) | Relative XDH Activity | Std Dev (+/−) | Relative XDH Activity | Std Dev (+/−) |
| Group 1: AD10631 | 1 | 0.000 | 0.268 | 0.060 | 0.273 | 0.049 | 0.553 | 0.135 |
| Group 2: AD09736 | 1 | 0.000 | 0.091 | 0.019 | 0.130 | 0.036 | 0.232 | 0.069 |
| Group 3: AD10621 | 1 | 0.000 | 0.052 | 0.004 | 0.161 | 0.063 | 0.186 | 0.080 |
| Group 4: AD09985 | 1 | 0.000 | 0.074 | 0.011 | 0.146 | 0.044 | 0.199 | 0.149 |

As noted above, each of AD09736 (Group 2), AD010621 (Group 3), and AD09985 (Group 4) obtained 90% or greater reductions in XDH activity, indicating these are highly potent XDH RNAi agents capable of reducing XDH protein expression by 90% in liver cells (hepatocytes). AD10631 was reported to have a 74% reduction in XDH activity, which is similar to what was seen with the XDH activity assay performed on cyno liver biopsy samples administered AD09611 (which targeted the same position on the XDH gene as AD10631) as reported in Example 13 and Example 21.

Example 23

In Vitro Testing of XDH RNAi Agents

Candidate sequence duplexes shown below in Table 50 were tested in vitro. The XDH RNAi agents were prepared in accordance with the procedures set forth in Example 1. The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand).

TABLE 50

| XDH RNAi Agents Tested for In Vitro Free Uptake Assay in Primary Human and Cynomolgus Monkey Hepatocytes | |
|---|---|
| RNAi Agent | Targeted Gene Position (within SEQ ID NO: 1) |
| AD09218 | 488 |
| AD09744 | 2696 |
| AD10012 | 2696 |
| AD10621 | 2696 |
| AD09736 | 1963 |
| AD09937 | 1963 |
| AD10278 | 1963 |
| AD09218 | 488 |
| AD09985 | 3598 |
| AD10731 | 3598 |
| AD09611 | 4289 |
| AD10184 | 4289 |
| AD10631 | 4289 |

Evaluation of XDH RNAi agents in vitro was performed by seeding primary human or cynomolgus monkey hepatocytes cells. Cells were seeded at 25,000 cells per well in 50 μL culture medium in 96-well collagen coated plate. Cells were treated with each of the XDH RNAi agent duplexes shown in Table 50 immediately after cells were seeded by adding 504 per well at 2× the final concentration, followed by gentle mixing and incubation at 3TC, 5% $CO_2$, for 48 hours without disturbing the cells. Isolation and purification of RNA was completed using a commercially available kit according to the manufacturer's instructions (Zymo Quick-RNA Miniprep Kit (Zymo Research, Irvine, Calif.)). Relative expression of each of the XDH RNAi agents was determined by qRT-PCR by comparing the expression levels of XDH mRNA to an endogenous control (PPIA).

A serial dilution of the RNAi agents was performed and the data curve fit to calculate the dose (concentration) required to knock down gene expression by 50% ("EC50," or effective concentration estimated to reduce gene expression by 50%). Residual XDH gene activity and EC50 of the XDH RNAi agents are shown below in Tables 51 and 52. Thus, for example, for RNAi agent AD10012, in primary human hepatocytes, at 1 nM, results in 0.2485 residual XDH gene relative expression, or 75.15% XDH gene knockdown. As further provided in Table 51, AD10012 was reported to have an EC50 of 0.012 nM (6 point repeat with free uptake in primary human hepatocytes), meaning AD10012 achieves 50% XDH gene knockdown at 0.012 nM concentration.

TABLE 51

In vitro inhibition of XDH RNAi Agents by free uptake in primary human hepatocytes

| RNAi Agent | RNAi Agent Concentration 0.01 nM Avg | SD | 0.1 nM | SD | 1 nM | SD | 10 nM | SD | 100 nM | SD | 1000 nM | SD | EC50 EC50 (nM) |
|---|---|---|---|---|---|---|---|---|---|---|---|---|---|
| AD09218 | 1.1908 | 0.4415 | 0.7427 | 0.2296 | 0.3515 | 0.1042 | 0.3459 | 0.1794 | 0.2624 | 0.0653 | 0.3672 | 0.1138 | 0.073 |
| AD09744 | 1.1048 | 0.2004 | 0.6711 | 0.0780 | 0.6122 | 0.0581 | 0.1599 | 0.0769 | 0.3055 | 0.0624 | 0.3551 | 0.1225 | 0.098 |
| AD10012 | 0.8735 | 0.0804 | 0.3435 | 0.0463 | 0.2485 | 0.0293 | 0.1707 | 0.1403 | 0.1840 | 0.0354 | 0.2882 | 0.1552 | 0.012 |
| AD10621 | 0.6962 | 0.1486 | 0.3373 | 0.0537 | 0.2388 | 0.0516 | 0.1614 | 0.0148 | 0.1714 | 0.0338 | 0.1947 | 0.0297 | 0.033 |
| AD09736 | 0.6916 | 0.0306 | 0.3905 | 0.0993 | 0.2970 | 0.0661 | 0.1534 | 0.0956 | 0.2394 | 0.0955 | 0.1572 | 0.0313 | 0.059 |
| AD09937 | 0.7534 | 0.1915 | 0.3373 | 0.0449 | 0.1919 | 0.0562 | 0.2224 | 0.0745 | 0.1309 | 0.0274 | 0.1282 | 0.0160 | 0.029 |
| AD10278 | 0.8245 | 0.1510 | 0.3776 | 0.0823 | 0.2635 | 0.0463 | 0.2347 | 0.0524 | 0.1359 | 0.0275 | 0.1295 | 0.0362 | 0.036 |
| AD09218 | 0.7578 | 0.4480 | 0.4888 | 0.0416 | 0.4312 | 0.1623 | 0.2016 | 0.0565 | 0.1651 | 0.0731 | 0.2039 | 0.0753 | 0.035 |
| AD09985 | 0.9439 | 0.0347 | 0.7353 | 0.1957 | 0.3808 | 0.1059 | 0.2642 | 0.0402 | 0.2657 | 0.0527 | 0.2820 | 0.1093 | 0.190 |
| AD10731 | 0.9885 | 0.0470 | 0.5503 | 0.0816 | 0.3282 | 0.0367 | 0.3649 | 0.1127 | 0.2777 | 0.0134 | 0.2634 | 0.0412 | 0.042 |
| AD09611 | 0.9968 | 0.0629 | 1.0893 | 0.2769 | 0.9445 | 0.0773 | 0.7137 | 0.1343 | 0.4735 | 0.0527 | 0.3751 | 0.0702 | 9.607 |
| AD10184 | 0.9568 | 0.1924 | 0.6296 | 0.0664 | 0.3272 | 0.0500 | 0.2448 | 0.0108 | 0.1962 | 0.0357 | 0.1766 | 0.0323 | 0.117 |
| AD10631 | 0.9386 | 0.0626 | 0.4900 | 0.1062 | 0.3561 | 0.0780 | 0.3252 | 0.1326 | 0.2606 | 0.0450 | 0.1594 | 0.0271 | 0.040 |

TABLE 52

In vitro inhibition of XDH RNAi Agents by free uptake in primary cynomolgus monkey hepatocytes

| RNAi Agent | RNAi Agent Concentration 0.06 nM | SD | 0.49 nM | SD | 3.91 nM | SD | 31.25 nM | SD | 250 nM | SD | 2000 nM | SD | EC50, number of repeat points EC50 (nM), 6× |
|---|---|---|---|---|---|---|---|---|---|---|---|---|---|
| AD09218 | 0.7835 | 0.1158 | 0.5673 | 0.0789 | 0.5559 | 0.1965 | 0.3457 | 0.1295 | 0.3402 | 0.0323 | 0.3044 | 0.0532 | 3.767 |
| AD09744 | 0.7400 | 0.0417 | 0.5543 | 0.0606 | 0.4657 | 0.0987 | 0.3451 | 0.0901 | 0.3667 | 0.0903 | 0.3446 | 0.1180 | 0.5439 |
| AD10012 | 0.6654 | 0.0098 | 0.4408 | 0.1139 | 0.3365 | 0.0168 | 0.2600 | 0.0335 | 0.2525 | 0.0334 | 0.2234 | 0.0236 | 0.3707 |
| AD10621 | 0.5571 | 0.1315 | 0.4494 | 0.1035 | 0.3046 | 0.1092 | 0.3036 | 0.0667 | 0.2430 | 0.0764 | 0.1819 | 0.0379 | 1.03 |
| AD09736 | 0.5093 | 0.0602 | 0.3650 | 0.0643 | 0.2476 | 0.0325 | 0.2683 | 0.0184 | 0.1759 | 0.0188 | 0.2002 | 0.0517 | 0.4216 |
| AD09937 | 0.5609 | 0.0444 | 0.3441 | 0.0388 | 0.2705 | 0.0203 | 0.2531 | 0.0565 | 0.1845 | 0.0197 | 0.1933 | 0.0394 | 0.2249 |
| AD10278 | 0.4772 | 0.0029 | 0.3957 | 0.0457 | 0.2929 | 0.0667 | 0.2837 | 0.0210 | 0.1784 | 0.0163 | 0.2003 | 0.0536 | 1.918 |
| AD09218 | 0.8383 | 0.2444 | 0.6405 | 0.1284 | 0.5279 | 0.0812 | 0.3616 | 0.0964 | 0.2885 | 0.0710 | 0.3272 | 0.0644 | 2.04 |
| AD09985 | 0.8656 | 0.0630 | 0.5815 | 0.0823 | 0.5065 | 0.0684 | 0.4399 | 0.0955 | 0.2934 | 0.0512 | 0.2938 | 0.0481 | 0.4581 |
| AD10731 | 0.7837 | 0.1459 | 0.4582 | 0.1026 | 0.3867 | 0.1169 | 0.4410 | 0.1221 | 0.2709 | 0.0683 | 0.2992 | 0.0018 | 0.09407 |
| AD09611 | 0.6219 | 0.0679 | 0.8340 | 0.1089 | 0.6923 | 0.1597 | 0.5281 | 0.1568 | 0.4321 | 0.0247 | 0.3780 | 0.0137 | 20.19 |
| AD10184 | 0.6263 | 0.0080 | 0.4306 | 0.0235 | 0.4214 | 0.0468 | 0.3293 | 0.0610 | 0.2743 | 0.0341 | 0.1787 | 0.0679 | 0.5228 |
| AD10631 | 0.5973 | 0.0231 | 0.5815 | 0.0713 | 0.5537 | 0.1817 | 0.5543 | 0.1779 | 0.3033 | 0.0283 | 0.3341 | 0.0497 | 77.08 |

Example 24

In Vivo Testing of XDH RNAi Agents in XDH-GLuc AAV Mice

The XDH-GLUC AAV mouse model described in Example 2, using the XDH-GLuc AAV containing the 80-2899 region of the human XDH cDNA sequence was used. At day 1, each mouse was given a single subcutaneous administration of 250 μl/25 g animal weight containing 2.0 mg/kg (mpk) of an XDH RNAi agent formulated in isotonic saline, or vehicle control (isotonic saline with no RNAi agent), according to Table 53.

TABLE 53

Targeted Positions and Dosing Groups of Example 24

| Group | Targeted Gene Position (within SEQ ID NO: 1) | RNAi Agent and Dose | Dosing Regimen |
|---|---|---|---|
| 1 | 2696 | Saline (no RNAi agent) | Single injection on day 1 |
| 2 | 2696 | 2.0 mg/kg AD09744 | Single injection on day 1 |

TABLE 53-continued

Targeted Positions and Dosing Groups of Example 24

| Group | Targeted Gene Position (within SEQ ID NO: 1) | RNAi Agent and Dose | Dosing Regimen |
|---|---|---|---|
| 3 | 2696 | 2.0 mg/kg AD10012 | Single injection on day 1 |
| 4 | 2696 | 2.0 mg/kg AD10619 | Single injection on day 1 |
| 5 | 2696 | 2.0 mg/kg AD10620 | Single injection on day 1 |
| 6 | 2696 | 2.0 mg/kg AD10621 | Single injection on day 1 |
| 7 | 2696 | 2.0 mg/kg AD10622 | Single injection on day 1 |
| 8 | 2696 | 2.0 mg/kg AD10623 | Single injection on day 1 |
| 9 | 2696 | 2.0 mg/kg AD10624 | Single injection on day 1 |
| 10 | 2696 | 2.0 mg/kg AD10625 | Single injection on day 1 |
| 11 | 2696 | 2.0 mg/kg AD10626 | Single injection on day 1 |
| 12 | 2696 | 2.0 mg/kg AD10627 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents in Groups 2-12 each included nucleotide sequences that were designed to inhibit expression of an XDH gene at position 2696 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15, and day 22, and XDH expression levels were determined pursuant to the procedure set forth in Example 2. Data from the experiment through day 22 are shown in Table 54:

TABLE 54

Average XDH Normalized to Pre-Treatment & Control in XDH-GLUC AAV Mice from Example 24

| | Day 8 | | Day 15 | | Day 22 | |
|---|---|---|---|---|---|---|
| Group ID | Avg XDH | Std Dev (+/−) | Avg XDH | Std Dev (+/−) | Avg XDH | Std Dev (+/−) |
| Group 1 (Saline vehicle) | 1.000 | 0.107 | 1.000 | 0.172 | 1.000 | 0.233 |
| Group 2 (2.0 mg/kg AD09744) | 0.585 | 0.079 | 0.616 | 0.024 | 0.659 | 0.088 |
| Group 3 (2.0 mg/kg AD10012) | 0.336 | 0.034 | 0.305 | 0.014 | 0.343 | 0.018 |
| Group 4 (2.0 mg/kg AD10619) | 0.397 | 0.034 | 0.415 | 0.011 | 0.415 | 0.046 |
| Group 5 (2.0 mg/kg AD10620) | 0.394 | 0.049 | 0.326 | 0.046 | 0.306 | 0.053 |
| Group 6 (2.0 mg/kg AD10621) | 0.403 | 0.038 | 0.312 | 0.049 | 0.348 | 0.026 |
| Group 7 (2.0 mg/kg AD10622) | 0.382 | 0.068 | 0.317 | 0.061 | 0.338 | 0.065 |
| Group 8 (2.0 mg/kg AD10623) | 0.280 | 0.124 | 0.268 | 0.053 | 0.258 | 0.137 |
| Group 9 (2.0 mg/kg AD10624) | 0.302 | 0.069 | 0.362 | 0.091 | 0.376 | 0.174 |
| Group 10 (2.0 mg/kg AD10625) | 0.341 | 0.048 | 0.342 | 0.096 | 0.412 | 0.079 |
| Group 11 (2.0 mg/kg AD10626) | 0.436 | 0.078 | 0.394 | 0.063 | 0.415 | 0.035 |
| Group 12 (2.0 mg/kg AD10627) | 0.317 | 0.041 | 0.325 | 0.023 | 0.322 | 0.041 |

Example 25

In Vivo Testing of XDH RNAi Agents in Cynomolgus Monkeys

XDH RNAi agents AD10621 and AD09985 were evaluated in cynomolgus monkeys (cynos). On day 1, three male cynos for each group (n=3) were administered a subcutaneous injection of 0.3 mL/kg (approximately 1.5 mL volume, depending on animal mass) containing 3 mg/kg or 1 mg/kg of the respective XDH RNAi agent, formulated in isotonic saline.

TABLE 55

Targeted Positions and Dosing Groups of Example 22

| Group | Targeted Gene Position (within SEQ ID NO: 1) | RNAi Agent and Dose | Dosing Regimen (on day 1) |
|---|---|---|---|
| 1 | 2696 | 3.0 mg/kg AD10621 | Single subcutaneous injection |
| 2 | 3598 | 3.0 mg/kg AD09985 | Single subcutaneous injection |
| 3 | 2696 | 1.0 mg/kg AD10621 | Single subcutaneous injection |
| 4 | 3598 | 1.0 mg/kg AD09985 | Single subcutaneous injection |

The XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents included nucleotide sequences that were designed to inhibit expression of a human XDH gene at the specific positions as shown in Table 55. (See, e.g., SEQ ID NO:1 and Table 2 for the XDH gene referenced).

On days −6 (day −3 for one of the animals), 29, 55, and 99 (day 100 for one of the animals), liver biopsies were taken. On the date of each biopsy collection, cynos were sedated and needles were used to extract two liver tissue samples approximately 20 mg each. Samples were weighed, snap-frozen and stored at −70° C. until analysis. The biopsy samples were then homogenized, and levels of cXDH mRNA in the cyno livers were measured by RT-qPCR using a housekeeping gene as reference. Resulting values were then normalized to the pre-dose (in this case, at day −6 or day −3) cXDH mRNA measurements. The resulting mRNA data are reflected in Table 56:

TABLE 56

Cyno XDH mRNA Levels Normalized to Pre-Dose (Day −6 or Day −3) from Example 25 for each Group (n = 3)

| | Pre-Dose (Day −6 or Day −3) | | | Day 29 | | |
|---|---|---|---|---|---|---|
| | Relative cXDH mRNA Expression | Low Error | High Error | Relative cXDH mRNA Expression | Low Error | High Error |
| Group 1: AD10621 | 1.000 | 0.107 | 0.120 | 0.585 | 0.098 | 0.118 |
| Group 2: AD09985 | 1.000 | 0.039 | 0.041 | 0.695 | 0.072 | 0.080 |
| Group 3: AD10621 | 1.000 | 0.114 | 0.128 | 0.864 | 0.138 | 0.165 |
| Group 4: AD09985 | 1.000 | 0.121 | 0.138 | 0.691 | 0.131 | 0.162 |

TABLE 56-continued

Cyno XDH mRNA Levels Normalized to Pre-Dose (Day −6 or Day −3) from Example 25 for each Group (n = 3)

| | Day 55 | | | Day 99 or Day 100 | | |
|---|---|---|---|---|---|---|
| | Relative cXDH mRNA Expression | Low Error | High Error | Relative cXDH mRNA Expression | Low Error | High Error |
| Group 1: AD10621 | 0.687 | 0.052 | 0.056 | 0.793 | 0.082 | 0.092 |
| Group 2: AD09985 | 0.708 | 0.087 | 0.100 | 0.678 | 0.121 | 0.148 |
| Group 3: AD10621 | 0.666 | 0.148 | 0.190 | 0.693 | 0.125 | 0.153 |
| Group 4: AD09985 | 0.720 | 0.112 | 0.132 | 0.676 | 0.149 | 0.191 |

Additionally, XDH activity was assessed using the XDH Activity Assay method described in Example 13. The resulting XDH activity data are shown in Table 57.

TABLE 57

Cyno XDH Activity Levels Normalized to Pre-Dose (Day −6) from Example 25 for each Group (n = 3)

| | Pre-Dose (Day −6 or Day −3) | | Day 29 | | Day 55 | | Day 99 or Day 100 | |
|---|---|---|---|---|---|---|---|---|
| | Relative XDH Activity | Std Dev (+/−) | Relative XDH Activity | Std Dev (+/−) | Relative XDH Activity | Std Dev (+/−) | Relative XDH Activity | Std Dev (+/−) |
| Group 1: AD10621 | 1 | 0.000 | 0.153 | 0.0048 | 0.399 | 0.2224 | 0.855 | 0.2914 |
| Group 2: AD09985 | 1 | 0.000 | 0.109 | 0.0139 | 0.221 | 0.1523 | 0.649 | 0.1959 |
| Group 3: AD10621 | 1 | 0.000 | 0.236 | 0.0452 | 0.343 | 0.3047 | 0.681 | 0.0675 |
| Group 4: AD09985 | 1 | 0.000 | 0.506 | 0.2290 | 0.517 | 0.2206 | 1.215 | 0.1157 |

As noted above, each of AD10621 (Group 1) and AD09985 (Group 2) obtained ~85% or greater reductions in XDH activity, indicating these are highly potent XDH RNAi agents capable of reducing XDH protein expression by ~85% in liver cells (hepatocytes).

Example 26

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) of an XDH RNAi agent formulated in isotonic saline, or vehicle control (isotonic saline with no RNAi agent), according to the following Table 58.

TABLE 58

Targeted Positions and Dosing Groups of Example 26

| Group | Targeted Gene Position (within SEQ ID NO: 1) | RNAi Agent and Dose | Dosing Regimen |
|---|---|---|---|
| 1 | N/A | Saline (no RNAi agent) | Single injection on day 1 |
| 2 | 488 | 2.0 mg/kg AD09218 | Single injection on day 1 |
| 3 | 139 | 2.0 mg/kg AD09725 | Single injection on day 1 |
| 4 | 235 | 2.0 mg/kg AD09598 | Single injection on day 1 |
| 5 | 239 | 2.0 mg/kg AD09726 | Single injection on day 1 |
| 6 | 332 | 2.0 mg/kg AD09727 | Single injection on day 1 |
| 7 | 2320 | 2.0 mg/kg AD09741 | Single injection on day 1 |
| 8 | 2357 | 2.0 mg/kg AD09742 | Single injection on day 1 |
| 9 | 2361 | 2.0 mg/kg AD09743 | Single injection on day 1 |
| 10 | 2696 | 2.0 mg/kg AD09744 | Single injection on day 1 |
| 11 | 2701 | 2.0 mg/kg AD09745 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents of Groups 2-11 all included nucleotide sequences that were designed to inhibit expression of an XDH gene at the positions of the gene listed on Table 58. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15 and day 22, and XDH expression levels were determined pursuant to the procedure set forth in Example 2, above. Data from the experiment through day 22 are shown in the following Table 59:

TABLE 59

| Average XDH Normalized to Pre-Treatment & Control in XDH-GLUC AAV Mice from Example 26 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 (Saline vehicle) | 1.000 | 0.066 | 1.000 | 0.104 | 1.000 | 0.084 |
| Group 2 2.0 mg/kg AD09218 | 0.350 | 0.043 | 0.376 | 0.038 | 0.400 | 0.079 |
| Group 3 2.0 mg/kg AD09725 | 0.748 | 0.134 | 0.853 | 0.059 | 0.871 | 0.129 |
| Group 4 2.0 mg/kg AD09598 | 0.729 | 0.070 | 0.935 | 0.235 | 1.073 | 0.092 |
| Group 5 2.0 mg/kg AD09726 | 0.651 | 0.104 | 0.747 | 0.154 | 0.806 | 0.161 |
| Group 6 2.0 mg/kg AD09727 | 0.885 | 0.051 | 0.927 | 0.127 | 0.929 | 0.140 |
| Group 7 2.0 mg/kg AD09741 | 0.616 | 0.090 | 0.693 | 0.064 | 0.708 | 0.110 |
| Group 8 2.0 mg/kg AD09742 | 0.724 | 0.101 | 0.896 | 0.143 | 0.863 | 0.139 |
| Group 9 2.0 mg/kg AD09743 | 0.803 | 0.060 | 0.907 | 0.107 | 0.841 | 0.130 |
| Group 10 2.0 mg/kg AD09744 | 0.477 | 0.051 | 0.576 | 0.170 | 0.558 | 0.132 |
| Group 11 2.0 mg/kg AD09745 | 0.568 | 0.045 | 0.626 | 0.062 | 0.719 | 0.045 |

Example 27

In Vivo Testing of XDH RNAi Agents in XDH-GLuc AAV Mice

The XDH-GLUC AAV mouse model described in Example 2, above, using the XDH-GLuc AAV containing the 80-2899 region of the human XDH cDNA sequence was used. At day 1, each mouse was given a single subcutaneous administration of 250 μl/25 g animal weight containing either 2.0 mg/kg (mpk) or 4.0 mg/kg (mpk) of an XDH RNAi agent formulated in isotonic saline, or vehicle control (isotonic saline with no RNAi agent), according to the following Table 60.

TABLE 60

| Targeted Positions and Dosing Groups of Example 27 | | | |
|---|---|---|---|
| Group | Targeted Gene Position (within SEQ ID NO: 1) | RNAi Agent and Dose | Dosing Regimen |
| 1 | N/A | Saline (no RNAi agent) | Single injection on day 1 |
| 2 | 2696 | 2.0 mg/kg AD10621 | Single injection on day 1 |
| 3 | 2696 | 4.0 mg/kg AD10621 | Single injection on day 1 |
| 4 | 2701 | 2.0 mg/kg AD09745 | Single injection on day 1 |
| 5 | 2701 | 4.0 mg/kg AD09745 | Single injection on day 1 |
| 6 | 2701 | 2.0 mg/kg AD12167 | Single injection on day 1 |
| 7 | 2701 | 4.0 mg/kg AD12167 | Single injection on day 1 |

TABLE 60-continued

| Targeted Positions and Dosing Groups of Example 27 | | | |
|---|---|---|---|
| Group | Targeted Gene Position (within SEQ ID NO: 1) | RNAi Agent and Dose | Dosing Regimen |
| 8 | 2696 | 2.0 mg/kg AD12168 | Single injection on day 1 |
| 9 | 2696 | 4.0 mg/kg AD12168 | Single injection on day 1 |

Each of the XDH RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the XDH RNAi agents, including (NAG37)s ligand). The XDH RNAi agents of Groups 2-9 all included nucleotide sequences that were designed to inhibit expression of an XDH gene at positions 2696 and 2701 of the gene. (See, e.g., SEQ ID NO:1 and Table 2 for the XDH gene referenced).

The injections were performed between the skin and muscle (i.e. subcutaneous injections) into the loose skin over the neck and shoulder area. Four (4) mice in each group were tested (n=4). Serum was collected on day 1 (pre-treatment), day 8, day 15 and day 22, and XDH expression levels were determined pursuant to the procedure set forth in Example 2, above. Data from the experiment through day 22 are shown in the following Table 60.

TABLE 60

| Average XDH Normalized to Pre-Treatment & Control in XDH-GLUC AAV Mice from Example 27 | | | | | | |
|---|---|---|---|---|---|---|
| | Day 8 | | Day 15 | | Day 22 | |
| Group ID | Avg XDH | Std Dev (+/−) | Avg XDH | Std Dev (+/−) | Avg XDH | Std Dev (+/−) |
| Group 1 Saline (no RNAi agent) | 1.000 | 0.064 | 1.000 | 0.152 | 1.000 | 0.247 |
| Group 2 2.0 mg/kg AD10621 | 0.449 | 0.072 | 0.317 | 0.108 | 0.410 | 0.095 |
| Group 3 4.0 mg/kg AD10621 | 0.317 | 0.040 | 0.184 | 0.038 | 0.232 | 0.059 |
| Group 4 2.0 mg/kg AD09745 | 0.809 | 0.214 | 0.567 | 0.196 | 0.690 | 0.281 |
| Group 5 4.0 mg/kg AD09745 | 0.590 | 0.090 | 0.347 | 0.047 | 0.408 | 0.026 |
| Group 6 2.0 mg/kg AD12167 | 0.712 | 0.072 | 0.546 | 0.124 | 0.650 | 0.211 |
| Group 7 4.0 mg/kg AD12167 | 0.522 | 0.087 | 0.297 | 0.093 | 0.385 | 0.092 |
| Group 8 2.0 mg/kg AD12168 | 0.881 | 0.126 | 0.497 | 0.029 | 0.631 | 0.120 |
| Group 9 4.0 mg/kg AD12168 | 0.500 | 0.019 | 0.327 | 0.028 | 0.359 | 0.060 |

As shown in Table 60, the XDH RNAi agent of Group 2 and 3 (AD010621) showed superior XHD inhibition compared to each of the RNAi agents in Groups 4-9 in vivo. For example, a single dose of 2.0 mg/kg of AD10621 reported approximately 59% inhibition of XDH (0.410) and a single 4.0 mg/kg dose reported approximately 77% inhibition (0.232) on day 22.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

a nucleic acid sequence of cucucucaGfaGfuAfuuauggaa (SEQ ID NO: 1663) and the antisense strand comprises a nucleic acid sequence of cPrpusUfscCfauaauacUfcUfgAfgagsasg (SEQ ID NO: 1146), wherein lower case (n)=2'-O-Me modified nucleotide; Nf=2'-F modified nucleotide; cPrpn=5'-cyclopropyl phosphonate-2'-O-methyl modified nucleotide; and s=phosphorothioate backbone modification; and administering the subject the RNAi agent, thereby treating the XDH-related disease.

2. The method of claim 1, wherein the sense strand further comprises an inverted abasic residue at each of the 5' end and the 3' end.

SEQUENCE LISTING (1688 sequences)

SEQ ID NO: 1 - DNA, 5715 bp, synthetic construct
  misc_feature 1..5715: note = Homo sapiens xanthine dehydrogenase (XDH), mRNA transcript(NM_000379.4)
  source 1..5715: mol_type = other DNA
acagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctgg

SEQ ID NO: 2 - RNA, 19 nt, synthetic construct
  misc_feature 1..19: note = XDH 19-mer gene transcript (mRNA) target sequence
  source 1..19: mol_type = other RNA
tcagcttcttcttcaagtt

SEQ ID NO: 3 - RNA, 19 nt, synthetic construct
  misc_feature 1..19: note = XDH 19-mer gene transcript (mRNA) target sequence
  source 1..19: mol_type = other RNA
agcttcttcttcaagttct

SEQ ID NO: 4 - RNA, 19 nt, synthetic construct
  misc_feature 1..19: note = XDH 19-mer gene transcript (mRNA) target sequence
  source 1..19: mol_type = other RNA
ttcttcttcaagttctacc

SEQ ID NO: 5 - RNA, 19 nt, synthetic construct
  misc_feature 1..19: note = XDH 19-mer gene transcript (mRNA) target sequence
  source 1..19: mol_type = other RNA
gggtgaaaatcacctatga

SEQ ID NO: 6 - RNA, 19 nt, synthetic construct
  misc_feature 1..19: note = XDH 19-mer gene transcript (mRNA) target sequence
  source 1..19: mol_type = other RNA
gtgaaaatcacctatgaag

SEQ ID NO: 7 - RNA, 19 nt, synthetic construct
  misc_feature 1..19: note = XDH 19-mer gene transcript (mRNA) target sequence
  source 1..19: mol_type = other RNA
tgaaaatcacctatgaaga

SEQ ID NO: 8 - RNA, 19 nt, synthetic construct
  misc_feature 1..19: note = XDH 19-mer gene transcript (mRNA) target sequence
  source 1..19: mol_type = other RNA
gaaaatcacctatgaagaa

SEQ ID NO: 9 - RNA, 19 nt, synthetic construct
  misc_feature 1..19: note = XDH 19-mer gene transcript (mRNA) target sequence
  source 1..19: mol_type = other RNA
accagccattatcacaatt

SEQ ID NO: 10 - RNA, 19 nt, synthetic construct
  misc_feature 1..19: note = XDH 19-mer gene transcript (mRNA) target sequence
  source 1..19: mol_type = other RNA
agaacaactccttttatgg

SEQ ID NO: 11 - RNA, 19 nt, synthetic construct
  misc_feature 1..19: note = XDH 19-mer gene transcript (mRNA) target sequence
  source 1..19: mol_type = other RNA
gaacaactccttttatgga

SEQ ID NO: 12 - RNA, 19 nt, synthetic construct
  misc_feature 1..19: note = XDH 19-mer gene transcript (mRNA) target sequence
  source 1..19: mol_type = other RNA
gacaagcactaacactgtg

SEQ ID NO: 13 - RNA, 19 nt, synthetic construct
  misc_feature 1..19: note = XDH 19-mer gene transcript (mRNA) target sequence
  source 1..19: mol_type = other RNA
gtcatgagtatgtacacac

SEQ ID NO: 14 - RNA, 19 nt, synthetic construct
  misc_feature 1..19: note = XDH 19-mer gene transcript (mRNA) target sequence
  source 1..19: mol_type = other RNA
gacatgctgataactggtg

SEQ ID NO: 15 - RNA, 19 nt, synthetic construct
  misc_feature 1..19: note = XDH 19-mer gene transcript (mRNA) target sequence
  source 1..19: mol_type = other RNA
atacaaggttggcttcatg

SEQ ID NO: 16 - RNA, 19 nt, synthetic construct
  misc_feature 1..19: note = XDH 19-mer gene transcript (mRNA) target sequence
  source 1..19: mol_type = other RNA
aaggttggcttcatgaaga

SEQ ID NO: 17 - RNA, 19 nt, synthetic construct
  misc_feature 1..19: note = XDH 19-mer gene transcript (mRNA) target sequence
  source 1..19: mol_type = other RNA
aggttggcttcatgaagac

SEQ ID NO: 18 - RNA, 19 nt, synthetic construct
  misc_feature 1..19: note = XDH 19-mer gene transcript (mRNA) target sequence
  source 1..19: mol_type = other RNA
gttggcttcatgaagactg

SEQ ID NO: 19 - RNA, 19 nt, synthetic construct
  misc_feature 1..19: note = XDH 19-mer gene transcript (mRNA) target sequence
  source 1..19: mol_type = other RNA
gagaattgttggaaaaaga

SEQ ID NO: 20 - RNA, 19 nt, synthetic construct
  misc_feature 1..19: note = XDH 19-mer gene transcript (mRNA) target sequence
  source 1..19: mol_type = other RNA
ggcttgctctgaagtagaa

SEQ ID NO: 21 - RNA, 19 nt, synthetic construct
  misc_feature 1..19: note = XDH 19-mer gene transcript (mRNA) target sequence
  source 1..19: mol_type = other RNA
ttgctctgaagtagaaatc

SEQ ID NO: 22 - RNA, 19 nt, synthetic construct
  misc_feature 1..19: note = XDH 19-mer gene transcript (mRNA) target sequence
  source 1..19: mol_type = other RNA
ctgccattgatattggaca

SEQ ID NO: 23 - RNA, 19 nt, synthetic construct
  misc_feature 1..19: note = XDH 19-mer gene transcript (mRNA) target sequence
  source 1..19: mol_type = other RNA
agatcgtccacttttctgc

SEQ ID NO: 24 - RNA, 19 nt, synthetic construct
  misc_feature 1..19: note = XDH 19-mer gene transcript (mRNA) target sequence
  source 1..19: mol_type = other RNA
ccgaagcagataatgttgt

SEQ ID NO: 25 - RNA, 19 nt, synthetic construct
  misc_feature 1..19: note = XDH 19-mer gene transcript (mRNA) target sequence
  source 1..19: mol_type = other RNA
ctctctcagagtattatgg

SEQ ID NO: 26 - RNA, 19 nt, synthetic construct
  misc_feature 1..19: note = XDH 19-mer gene transcript (mRNA) target sequence
  source 1..19: mol_type = other RNA
caccaagtttggaataagc

SEQ ID NO: 27 - RNA, 19 nt, synthetic construct
  misc_feature 1..19: note = XDH 19-mer gene transcript (mRNA) target sequence
  source 1..19: mol_type = other RNA
gcataaagcaagattactc

SEQ ID NO: 28 - RNA, 19 nt, synthetic construct
  misc_feature 1..19: note = XDH 19-mer gene transcript (mRNA) target sequence
  source 1..19: mol_type = other RNA
caatgttctagatttcttt

SEQ ID NO: 29 - RNA, 19 nt, synthetic construct
  misc_feature 1..19: note = XDH 19-mer gene transcript (mRNA) target sequence
  source 1..19: mol_type = other RNA
tgctggatgagtgaagttg

SEQ ID NO: 30 - RNA, 19 nt, synthetic construct
  misc_feature 1..19: note = XDH 19-mer gene transcript (mRNA) target sequence
  source 1..19: mol_type = other RNA
gctggatgagtgaagttgc

SEQ ID NO: 31 - RNA, 19 nt, synthetic construct
  misc_feature 1..19: note = XDH 19-mer gene transcript (mRNA) target sequence
  source 1..19: mol_type = other RNA
ctggatgagtgaagttgca

SEQ ID NO: 32 - RNA, 19 nt, synthetic construct
  misc_feature 1..19: note = XDH 19-mer gene transcript (mRNA) target sequence
  source 1..19: mol_type = other RNA
tgctctccaagtatgatcg

SEQ ID NO: 33 - RNA, 19 nt, synthetic construct
  misc_feature 1..19: note = XDH 19-mer gene transcript (mRNA) target sequence
  source 1..19: mol_type = other RNA
gatcgtctgcagaacaaga

SEQ ID NO: 34 - RNA, 19 nt, synthetic construct
  misc_feature 1..19: note = XDH 19-mer gene transcript (mRNA) target sequence
  source 1..19: mol_type = other RNA
cgtctgcagaacaagatcg

SEQ ID NO: 35 - RNA, 19 nt, synthetic construct
  misc_feature 1..19: note = XDH 19-mer gene transcript (mRNA) target sequence
  source 1..19: mol_type = other RNA
cgccagtgcaactttactg

SEQ ID NO: 36 - RNA, 19 nt, synthetic construct
  misc_feature 1..19: note = XDH 19-mer gene transcript (mRNA) target sequence
  source 1..19: mol_type = other RNA
gataaggttacttgtgttg

SEQ ID NO: 37 - RNA, 19 nt, synthetic construct
  misc_feature 1..19: note = XDH 19-mer gene transcript (mRNA) target sequence
  source 1..19: mol_type = other RNA
cagccattatcacaattga

SEQ ID NO: 38 - RNA, 19 nt, synthetic construct
  misc_feature 1..19: note = XDH 19-mer gene transcript (mRNA) target sequence
  source 1..19: mol_type = other RNA
agctctcagtatcatgctc

SEQ ID NO: 39 - RNA, 19 nt, synthetic construct
  misc_feature 1..19: note = XDH 19-mer gene transcript (mRNA) target sequence
  source 1..19: mol_type = other RNA
agagtgaggttgacaagtt

SEQ ID NO: 40 - RNA, 19 nt, synthetic construct
  misc_feature 1..19: note = XDH 19-mer gene transcript (mRNA) target sequence
  source 1..19: mol_type = other RNA
gagtgaggttgacaagttc

SEQ ID NO: 41 - RNA, 19 nt, synthetic construct
  misc_feature 1..19: note = XDH 19-mer gene transcript (mRNA) target sequence
  source 1..19: mol_type = other RNA
tcaacaaggagaattgttg

SEQ ID NO: 42 - RNA, 19 nt, synthetic construct
  misc_feature 1..19: note = XDH 19-mer gene transcript (mRNA) target sequence
  source 1..19: mol_type = other RNA
aacataccacagaacatgg

SEQ ID NO: 43 - RNA, 19 nt, synthetic construct
  misc_feature 1..19: note = XDH 19-mer gene transcript (mRNA) target sequence
  source 1..19: mol_type = other RNA
acatggatctattaaagtc

SEQ ID NO: 44 - RNA, 19 nt, synthetic construct
  misc_feature 1..19: note = XDH 19-mer gene transcript (mRNA) target sequence
  source 1..19: mol_type = other RNA
catggatctattaaagtca

SEQ ID NO: 45 - RNA, 19 nt, synthetic construct
  misc_feature 1..19: note = XDH 19-mer gene transcript (mRNA) target sequence
  source 1..19: mol_type = other RNA
cctaaatggtgaatatgca

SEQ ID NO: 46 - RNA, 19 nt, synthetic construct
  misc_feature 1..19: note = XDH 19-mer gene transcript (mRNA) target sequence
  source 1..19: mol_type = other RNA
acctctagaagcttaaacc

SEQ ID NO: 47 - RNA, 19 nt, synthetic construct
  misc_feature 1..19: note = XDH 19-mer gene transcript (mRNA) target sequence
  source 1..19: mol_type = other RNA
ccttcaaaccaatgaacag

SEQ ID NO: 48 - RNA, 19 nt, synthetic construct
  misc_feature 1..19: note = XDH 19-mer gene transcript (mRNA) target sequence
  source 1..19: mol_type = other RNA
aatgaacagcaaagcataa

SEQ ID NO: 49 - RNA, 19 nt, synthetic construct
  misc_feature 1..19: note = XDH 19-mer gene transcript (mRNA) target sequence
  source 1..19: mol_type = other RNA
tgaacagcaaagcataacc

SEQ ID NO: 50 - RNA, 19 nt, synthetic construct
  misc_feature 1..19: note = XDH 19-mer gene transcript (mRNA) target sequence
  source 1..19: mol_type = other RNA
gaacagcaaagcataacct

SEQ ID NO: 51 - RNA, 19 nt, synthetic construct
  misc_feature 1..19: note = XDH 19-mer gene transcript (mRNA) target sequence
  source 1..19: mol_type = other RNA
acagcaaagcataaccttg

SEQ ID NO: 52 - RNA, 19 nt, synthetic construct
  misc_feature 1..19: note = XDH 19-mer gene transcript (mRNA) target sequence
  source 1..19: mol_type = other RNA
aaagcataaccttgaatct

SEQ ID NO: 53 - RNA, 19 nt, synthetic construct
  misc_feature 1..19: note = XDH 19-mer gene transcript (mRNA) target sequence
  source 1..19: mol_type = other RNA
aaccaactcaattattgag

SEQ ID NO: 54 - RNA, 19 nt, synthetic construct
  misc_feature 1..19: note = XDH 19-mer gene transcript (mRNA) target sequence
  source 1..19: mol_type = other RNA
tcctgtgatccattttact

SEQ ID NO: 55 - RNA, 19 nt, synthetic construct
  misc_feature 1..19: note = XDH 19-mer gene transcript (mRNA) target sequence
  source 1..19: mol_type = other RNA
ttttcttactgtcatatga

SEQ ID NO: 56 - RNA, 19 nt, synthetic construct
  misc_feature 1..19: note = XDH 19-mer gene transcript (mRNA) target sequence
  source 1..19: mol_type = other RNA
ggagaaaaatgcagatcca

SEQ ID NO: 57 - RNA, 19 nt, synthetic construct
  misc_feature 1..19: note = XDH 19-mer gene transcript (mRNA) target sequence
  source 1..19: mol_type = other RNA
cagagacaacccttttggc

SEQ ID NO: 58 - RNA, 19 nt, synthetic construct
  misc_feature 1..19: note = XDH 19-mer gene transcript (mRNA) target sequence
  source 1..19: mol_type = other RNA
ctccaagtatgatcgtctg

SEQ ID NO: 59 - RNA, 19 nt, synthetic construct
  misc_feature 1..19: note = XDH 19-mer gene transcript (mRNA) target sequence
  source 1..19: mol_type = other RNA
aactgtggaaggaatagga

SEQ ID NO: 60 - RNA, 19 nt, synthetic construct
  misc_feature 1..19: note = XDH 19-mer gene transcript (mRNA) target sequence
  source 1..19: mol_type = other RNA
gcatcgtcatgagtatgta

SEQ ID NO: 61 - RNA, 19 nt, synthetic construct
  misc_feature 1..19: note = XDH 19-mer gene transcript (mRNA) target sequence
  source 1..19: mol_type = other RNA
cttccaaggaaatctgtgc

SEQ ID NO: 62 - RNA, 19 nt, synthetic construct
  misc_feature 1..19: note = XDH 19-mer gene transcript (mRNA) target sequence
  source 1..19: mol_type = other RNA
ggcattgagatgaagttca

SEQ ID NO: 63 - RNA, 19 nt, synthetic construct
  misc_feature 1..19: note = XDH 19-mer gene transcript (mRNA) target sequence
  source 1..19: mol_type = other RNA
tgaagttcaagaatatgct

SEQ ID NO: 64 - RNA, 19 nt, synthetic construct
  misc_feature 1..19: note = XDH 19-mer gene transcript (mRNA) target sequence
  source 1..19: mol_type = other RNA
aatatgctgtttcctatga

SEQ ID NO: 65 - RNA, 19 nt, synthetic construct
  misc_feature 1..19: note = XDH 19-mer gene transcript (mRNA) target sequence
  source 1..19: mol_type = other RNA
tgctctccatagagatccc

SEQ ID NO: 66 - RNA, 19 nt, synthetic construct
  misc_feature 1..19: note = XDH 19-mer gene transcript (mRNA) target sequence
  source 1..19: mol_type = other RNA
gtatttctcagcattcaag

SEQ ID NO: 67 - RNA, 19 nt, synthetic construct
  misc_feature 1..19: note = XDH 19-mer gene transcript (mRNA) target sequence
  source 1..19: mol_type = other RNA
ccaagatcaagtccataga

SEQ ID NO: 68 - RNA, 19 nt, synthetic construct
  misc_feature 1..19: note = XDH 19-mer gene transcript (mRNA) target sequence
  source 1..19: mol_type = other RNA
cagggtttgtttgtttcat

SEQ ID NO: 69 - RNA, 19 nt, synthetic construct
  misc_feature 1..19: note = XDH 19-mer gene transcript (mRNA) target sequence
  source 1..19: mol_type = other RNA
cacctatgaagaactacca

SEQ ID NO: 70 - RNA, 19 nt, synthetic construct
  misc_feature 1..19: note = XDH 19-mer gene transcript (mRNA) target sequence
  source 1..19: mol_type = other RNA
gaactaccagccattatca

SEQ ID NO: 71 - RNA, 19 nt, synthetic construct
  misc_feature 1..19: note = XDH 19-mer gene transcript (mRNA) target sequence
  source 1..19: mol_type = other RNA
gccattatcacaattgagg

SEQ ID NO: 72 - RNA, 19 nt, synthetic construct
  misc_feature 1..19: note = XDH 19-mer gene transcript (mRNA) target sequence
  source 1..19: mol_type = other RNA
agctgaagatcgagaaagg

SEQ ID NO: 73 - RNA, 19 nt, synthetic construct
  misc_feature 1..19: note = XDH 19-mer gene transcript (mRNA) target sequence
  source 1..19: mol_type = other RNA
gcaccattgctgttccaaa

SEQ ID NO: 74 - RNA, 19 nt, synthetic construct
  misc_feature 1..19: note = XDH 19-mer gene transcript (mRNA) target sequence
  source 1..19: mol_type = other RNA
ggagctctttgtgtctaca

SEQ ID NO: 75 - RNA, 19 nt, synthetic construct
  misc_feature 1..19: note = XDH 19-mer gene transcript (mRNA) target sequence
  source 1..19: mol_type = other RNA
ctctttgtgtctacacaga

SEQ ID NO: 76 - RNA, 19 nt, synthetic construct
  misc_feature 1..19: note = XDH 19-mer gene transcript (mRNA) target sequence
  source 1..19: mol_type = other RNA
ctctcagagtattatggaa

SEQ ID NO: 77 - RNA, 19 nt, synthetic construct
  misc_feature 1..19: note = XDH 19-mer gene transcript (mRNA) target sequence
  source 1..19: mol_type = other RNA
agagtattatggaacgagc

SEQ ID NO: 78 - RNA, 19 nt, synthetic construct
  misc_feature 1..19: note = XDH 19-mer gene transcript (mRNA) target sequence
  source 1..19: mol_type = other RNA
agggtttgtttgtttcatt

SEQ ID NO: 79 - RNA, 19 nt, synthetic construct
  misc_feature 1..19: note = XDH 19-mer gene transcript (mRNA) target sequence
  source 1..19: mol_type = other RNA
gggtttgtttgtttcattt

SEQ ID NO: 80 - RNA, 19 nt, synthetic construct
  misc_feature 1..19: note = XDH 19-mer gene transcript (mRNA) target sequence
  source 1..19: mol_type = other RNA
gtttgtttgtttcatttcc

SEQ ID NO: 81 - RNA, 19 nt, synthetic construct
  misc_feature 1..19: note = XDH 19-mer gene transcript (mRNA) target sequence
  source 1..19: mol_type = other RNA
tctccaagtatgatcgtct

SEQ ID NO: 82 - RNA, 19 nt, synthetic construct
  misc_feature 1..19: note = XDH 19-mer gene transcript (mRNA) target sequence
  source 1..19: mol_type = other RNA
aggagattgagaatgcctt

SEQ ID NO: 83 - RNA, 19 nt, synthetic construct
  misc_feature 1..19: note = XDH 19-mer gene transcript (mRNA) target sequence
  source 1..19: mol_type = other RNA
agaatgccttccaaggaaa

SEQ ID NO: 84 - RNA, 19 nt, synthetic construct
  misc_feature 1..19: note = XDH 19-mer gene transcript (mRNA) target sequence
  source 1..19: mol_type = other RNA
tgccttccaaggaaatctg

SEQ ID NO: 85 - RNA, 19 nt, synthetic construct
  misc_feature 1..19: note = XDH 19-mer gene transcript (mRNA) target sequence
  source 1..19: mol_type = other RNA
agaatatgctgtttcctat

SEQ ID NO: 86 - RNA, 19 nt, synthetic construct
  misc_feature 1..19: note = XDH 19-mer gene transcript (mRNA) target sequence
  source 1..19: mol_type = other RNA
ttggagggaacatcatcac

SEQ ID NO: 87 - RNA, 19 nt, synthetic construct
  misc_feature 1..19: note = XDH 19-mer gene transcript (mRNA) target sequence
  source 1..19: mol_type = other RNA
gcttcttcttcaagttcta

SEQ ID NO: 88 - RNA, 19 nt, synthetic construct
  misc_feature 1..19: note = XDH 19-mer gene transcript (mRNA) target sequence
  source 1..19: mol_type = other RNA
gttgggcatatcattggtg

SEQ ID NO: 89 - RNA, 19 nt, synthetic construct
  misc_feature 1..19: note = XDH 19-mer gene transcript (mRNA) target sequence
  source 1..19: mol_type = other RNA
tctacacagaacaccatga

SEQ ID NO: 90 - RNA, 19 nt, synthetic construct
  misc_feature 1..19: note = XDH 19-mer gene transcript (mRNA) target sequence
  source 1..19: mol_type = other RNA
cacccaggatctctctcag

SEQ ID NO: 91 - RNA, 19 nt, synthetic construct
  misc_feature 1..19: note = XDH 19-mer gene transcript (mRNA) target sequence
  source 1..19: mol_type = other RNA
caagctctcagtatcatgc

SEQ ID NO: 92 - RNA, 19 nt, synthetic construct
  misc_feature 1..19: note = XDH 19-mer gene transcript (mRNA) target sequence
  source 1..19: mol_type = other RNA
ggaagagtgaggttgacaa

SEQ ID NO: 93 - RNA, 19 nt, synthetic construct
  misc_feature 1..19: note = XDH 19-mer gene transcript (mRNA) target sequence
  source 1..19: mol_type = other RNA
caaggagaattgttggaaa

SEQ ID NO: 94 - RNA, 19 nt, synthetic construct
  misc_feature 1..19: note = XDH 19-mer gene transcript (mRNA) target sequence
  source 1..19: mol_type = other RNA
agctttgagactaactcag

SEQ ID NO: 95 - RNA, 19 nt, synthetic construct
  misc_feature 1..19: note = XDH 19-mer gene transcript (mRNA) target sequence
  source 1..19: mol_type = other RNA
tccgcacagatattgtcat

SEQ ID NO: 96 - RNA, 19 nt, synthetic construct
  misc_feature 1..19: note = XDH 19-mer gene transcript (mRNA) target sequence
  source 1..19: mol_type = other RNA
cgcacagatattgtcatgg

SEQ ID NO: 97 - RNA, 19 nt, synthetic construct
  misc_feature 1..19: note = XDH 19-mer gene transcript (mRNA) target sequence
  source 1..19: mol_type = other RNA
ctgcttctatcttctttgc

SEQ ID NO: 98 - RNA, 19 nt, synthetic construct
  misc_feature 1..19: note = XDH 19-mer gene transcript (mRNA) target sequence
  source 1..19: mol_type = other RNA
cacacaggtaataacgtga

SEQ ID NO: 99 - RNA, 19 nt, synthetic construct
  misc_feature 1..19: note = XDH 19-mer gene transcript (mRNA) target sequence
  source 1..19: mol_type = other RNA
tgtataacctcaagttctg

SEQ ID NO: 100 - RNA, 19 nt, synthetic construct
  misc_feature 1..19: note = XDH 19-mer gene transcript (mRNA) target sequence
  source 1..19: mol_type = other RNA
ccaatgaacagcaaagcat

SEQ ID NO: 101 - RNA, 19 nt, synthetic construct
  misc_feature 1..19: note = XDH 19-mer gene transcript (mRNA) target sequence
  source 1..19: mol_type = other RNA
taaccttgaatctatactc

SEQ ID NO: 102 - RNA, 19 nt, synthetic construct
  misc_feature 1..19: note = XDH 19-mer gene transcript (mRNA) target sequence
  source 1..19: mol_type = other RNA
cataaagcaagattactct

SEQ ID NO: 103 - RNA, 19 nt, synthetic construct
  misc_feature 1..19: note = XDH 19-mer gene transcript (mRNA) target sequence
  source 1..19: mol_type = other RNA
cacctagaaatgatgctat

SEQ ID NO: 104 - RNA, 19 nt, synthetic construct
  misc_feature 1..19: note = XDH 19-mer gene transcript (mRNA) target sequence
  source 1..19: mol_type = other RNA
agctctgtctcttctgtct

SEQ ID NO: 105 - RNA, 19 nt, synthetic construct
  misc_feature 1..19: note = XDH 19-mer gene transcript (mRNA) target sequence
  source 1..19: mol_type = other RNA
aaggcttggttttcttact

SEQ ID NO: 106 - RNA, 19 nt, synthetic construct
  misc_feature 1..19: note = XDH 19-mer gene transcript (mRNA) target sequence
  source 1..19: mol_type = other RNA
gtgatgctctccaagtatg

SEQ ID NO: 107 - RNA, 19 nt, synthetic construct
  misc_feature 1..19: note = XDH 19-mer gene transcript (mRNA) target sequence
  source 1..19: mol_type = other RNA
caagtatgatcgtctgcag

SEQ ID NO: 108 - RNA, 19 nt, synthetic construct
  misc_feature 1..19: note = XDH 19-mer gene transcript (mRNA) target sequence
  source 1..19: mol_type = other RNA
gcatgagagttttattcaa

SEQ ID NO: 109 - RNA, 19 nt, synthetic construct
  misc_feature 1..19: note = XDH 19-mer gene transcript (mRNA) target sequence
  source 1..19: mol_type = other RNA
caagatcgtccacttttct

SEQ ID NO: 110 - RNA, 19 nt, synthetic construct
  misc_feature 1..19: note = XDH 19-mer gene transcript (mRNA) target sequence
  source 1..19: mol_type = other RNA
catgttgcagtgacaactg

SEQ ID NO: 111 - RNA, 19 nt, synthetic construct
  misc_feature 1..19: note = XDH 19-mer gene transcript (mRNA) target sequence
  source 1..19: mol_type = other RNA
tgacaactgtggaaggaat

SEQ ID NO: 112 - RNA, 19 nt, synthetic construct
  misc_feature 1..19: note = XDH 19-mer gene transcript (mRNA) target sequence
  source 1..19: mol_type = other RNA
ggaggagattgagaatgcc

SEQ ID NO: 113 - RNA, 19 nt, synthetic construct
  misc_feature 1..19: note = XDH 19-mer gene transcript (mRNA) target sequence
  source 1..19: mol_type = other RNA
cacggagattggcattgag

SEQ ID NO: 114 - RNA, 19 nt, synthetic construct
  misc_feature 1..19: note = XDH 19-mer gene transcript (mRNA) target sequence
  source 1..19: mol_type = other RNA
agatgaagttcaagaatat

SEQ ID NO: 115 - RNA, 19 nt, synthetic construct
  misc_feature 1..19: note = XDH 19-mer gene transcript (mRNA) target sequence
  source 1..19: mol_type = other RNA
gagatactgctctccatag

SEQ ID NO: 116 - RNA, 19 nt, synthetic construct
  misc_feature 1..19: note = XDH 19-mer gene transcript (mRNA) target sequence
  source 1..19: mol_type = other RNA
ggagtatttctcagcattc

SEQ ID NO: 117 - RNA, 19 nt, synthetic construct
  misc_feature 1..19: note = XDH 19-mer gene transcript (mRNA) target sequence
  source 1..19: mol_type = other RNA
gagtatttctcagcattca

SEQ ID NO: 118 - RNA, 19 nt, synthetic construct
  misc_feature 1..19: note = XDH 19-mer gene transcript (mRNA) target sequence
  source 1..19: mol_type = other RNA
ggagagaagatgacattgc

SEQ ID NO: 119 - RNA, 19 nt, synthetic construct
  misc_feature 1..19: note = XDH 19-mer gene transcript (mRNA) target sequence
  source 1..19: mol_type = other RNA
taacataactggaatttgt

SEQ ID NO: 120 - RNA, 19 nt, synthetic construct
  misc_feature 1..19: note = XDH 19-mer gene transcript (mRNA) target sequence
  source 1..19: mol_type = other RNA
agccattatcacaattgag

SEQ ID NO: 121 - RNA, 19 nt, synthetic construct
  misc_feature 1..19: note = XDH 19-mer gene transcript (mRNA) target sequence
  source 1..19: mol_type = other RNA
gctttgttgcaaaaatgtt

SEQ ID NO: 122 - RNA, 19 nt, synthetic construct
  misc_feature 1..19: note = XDH 19-mer gene transcript (mRNA) target sequence
  source 1..19: mol_type = other RNA
tttgttgcaaaaatgttgg

SEQ ID NO: 123 - RNA, 19 nt, synthetic construct
  misc_feature 1..19: note = XDH 19-mer gene transcript (mRNA) target sequence
  source 1..19: mol_type = other RNA
gattgtggttcgagtgaag

SEQ ID NO: 124 - RNA, 19 nt, synthetic construct
  misc_feature 1..19: note = XDH 19-mer gene transcript (mRNA) target sequence
  source 1..19: mol_type = other RNA
gattgagaatgccttccaa

SEQ ID NO: 125 - RNA, 19 nt, synthetic construct
  misc_feature 1..19: note = RNAi agent antisense strand 19-mer core base sequence
  source 1..19: mol_type = other RNA
aacttgaagaagaagctga

SEQ ID NO: 126 - RNA, 19 nt, synthetic construct
  misc_feature 1..19: note = RNAi agent antisense strand 19-mer core base sequence
  source 1..19: mol_type = other RNA
tacttgaagaagaagctga

SEQ ID NO: 127 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nacttgaagaagaagctga

SEQ ID NO: 128 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nacttgaagaagaagctgn

SEQ ID NO: 129 - RNA, 19 nt, synthetic construct
  misc_feature 1..19: note = RNAi agent antisense strand 19-mer core base sequence
  source 1..19: mol_type = other RNA
agaacttgaagaagaagct

SEQ ID NO: 130 - RNA, 19 nt, synthetic construct
  misc_feature 1..19: note = RNAi agent antisense strand 19-mer core base sequence
  source 1..19: mol_type = other RNA
tgaacttgaagaagaagct

SEQ ID NO: 131 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngaacttgaagaagaagct

SEQ ID NO: 132 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngaacttgaagaagaagcn

SEQ ID NO: 133 - RNA, 19 nt, synthetic construct
  misc_feature 1..19: note = RNAi agent antisense strand 19-mer core base sequence
  source 1..19: mol_type = other RNA
tgtagaacttgaagaagaa

SEQ ID NO: 134 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtagaacttgaagaagaa

SEQ ID NO: 135 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtagaacttgaagaagan

SEQ ID NO: 136 - RNA, 19 nt, synthetic construct
  misc_feature 1..19: note = RNAi agent antisense strand 19-mer core base sequence
  source 1..19: mol_type = other RNA
tcataggtgattttcaccc

SEQ ID NO: 137 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncataggtgattttcaccc

SEQ ID NO: 138 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncataggtgattttcaccn

SEQ ID NO: 139 - RNA, 19 nt, synthetic construct
  misc_feature 1..19: note = RNAi agent antisense strand 19-mer core base sequence
  source 1..19: mol_type = other RNA
tttcataggtgattttcac

SEQ ID NO: 140 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttcataggtgattttcac

SEQ ID NO: 141 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttcataggtgattttcan

SEQ ID NO: 142 - RNA, 19 nt, synthetic construct
  misc_feature 1..19: note = RNAi agent antisense strand 19-mer core base sequence
  source 1..19: mol_type = other RNA
tcttcataggtgattttca

SEQ ID NO: 143 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncttcataggtgattttca

SEQ ID NO: 144 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncttcataggtgattttcn

SEQ ID NO: 145 - RNA, 19 nt, synthetic construct
  misc_feature 1..19: note = RNAi agent antisense strand 19-mer core base sequence
  source 1..19: mol_type = other RNA
ttcttcataggtgattttc

SEQ ID NO: 146 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntcttcataggtgattttc

SEQ ID NO: 147 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntcttcataggtgattttn

SEQ ID NO: 148 - RNA, 19 nt, synthetic construct
  misc_feature 1..19: note = RNAi agent antisense strand 19-mer core base sequence
  source 1..19: mol_type = other RNA
aattgtgataatggctggt

SEQ ID NO: 149 - RNA, 19 nt, synthetic construct
  misc_feature 1..19: note = RNAi agent antisense strand 19-mer core base sequence
  source 1..19: mol_type = other RNA
tattgtgataatggctggt

SEQ ID NO: 150 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nattgtgataatggctggt

SEQ ID NO: 151 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nattgtgataatggctggn

SEQ ID NO: 152 - RNA, 19 nt, synthetic construct
  misc_feature 1..19: note = RNAi agent antisense strand 19-mer core base sequence
  source 1..19: mol_type = other RNA
tcataaaaggagttgttct

SEQ ID NO: 153 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncataaaaggagttgttct

SEQ ID NO: 154 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncataaaaggagttgttcn

SEQ ID NO: 155 - RNA, 19 nt, synthetic construct
  misc_feature 1..19: note = RNAi agent antisense strand 19-mer core base sequence
  source 1..19: mol_type = other RNA
tccataaaaggagttgttc

SEQ ID NO: 156 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nccataaaaggagttgttc

SEQ ID NO: 157 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nccataaaaggagttgttn

SEQ ID NO: 158 - RNA, 19 nt, synthetic construct
  misc_feature 1..19: note = RNAi agent antisense strand 19-mer core base sequence
  source 1..19: mol_type = other RNA
tacagtgttagtgcttgtc

SEQ ID NO: 159 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nacagtgttagtgcttgtc

SEQ ID NO: 160 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nacagtgttagtgcttgtn

SEQ ID NO: 161 - RNA, 19 nt, synthetic construct
  misc_feature 1..19: note = RNAi agent antisense strand 19-mer core base sequence
  source 1..19: mol_type = other RNA
ttgtgtacatactcatgac

SEQ ID NO: 162 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgtgtacatactcatgac

SEQ ID NO: 163 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgtgtacatactcatgan

SEQ ID NO: 164 - RNA, 19 nt, synthetic construct
  misc_feature 1..19: note = RNAi agent antisense strand 19-mer core base sequence
  source 1..19: mol_type = other RNA
taccagttatcagcatgtc

SEQ ID NO: 165 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naccagttatcagcatgtc

SEQ ID NO: 166 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naccagttatcagcatgtn

SEQ ID NO: 167 - RNA, 19 nt, synthetic construct
  misc_feature 1..19: note = RNAi agent antisense strand 19-mer core base sequence
  source 1..19: mol_type = other RNA
taccagttatcagcatgtc

SEQ ID NO: 168 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naccagttatcagcatgtc

SEQ ID NO: 169 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naccagttatcagcatgtn

SEQ ID NO: 170 - RNA, 19 nt, synthetic construct
  misc_feature 1..19: note = RNAi agent antisense strand 19-mer core base sequence
  source 1..19: mol_type = other RNA
tatgaagccaaccttgtat

SEQ ID NO: 171 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
natgaagccaaccttgtat

SEQ ID NO: 172 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
natgaagccaaccttgtan

SEQ ID NO: 173 - RNA, 19 nt, synthetic construct
  misc_feature 1..19: note = RNAi agent antisense strand 19-mer core base sequence
  source 1..19: mol_type = other RNA
tcttcatgaagccaacctt

SEQ ID NO: 174 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncttcatgaagccaacctt

SEQ ID NO: 175 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncttcatgaagccaacctn

SEQ ID NO: 176 - RNA, 19 nt, synthetic construct
  misc_feature 1..19: note = RNAi agent antisense strand 19-mer core base sequence
  source 1..19: mol_type = other RNA
ttcttcatgaagccaacct

SEQ ID NO: 177 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntcttcatgaagccaacct

SEQ ID NO: 178 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntcttcatgaagccaaccn

SEQ ID NO: 179 - RNA, 19 nt, synthetic construct
  misc_feature 1..19: note = RNAi agent antisense strand 19-mer core base sequence
  source 1..19: mol_type = other RNA
tagtcttcatgaagccaac

SEQ ID NO: 180 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagtcttcatgaagccaac

SEQ ID NO: 181 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagtcttcatgaagccaan

SEQ ID NO: 182 - RNA, 19 nt, synthetic construct
  misc_feature 1..19: note = RNAi agent antisense strand 19-mer core base sequence
  source 1..19: mol_type = other RNA
tctttttccaacaattctc

SEQ ID NO: 183 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctttttccaacaattctc

SEQ ID NO: 184 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctttttccaacaattctn

SEQ ID NO: 185 - RNA, 19 nt, synthetic construct
  misc_feature 1..19: note = RNAi agent antisense strand 19-mer core base sequence
  source 1..19: mol_type = other RNA
ttctacttcagagcaagcc

SEQ ID NO: 186 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntctacttcagagcaagcc

SEQ ID NO: 187 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntctacttcagagcaagcn

SEQ ID NO: 188 - RNA, 19 nt, synthetic construct
  misc_feature 1..19: note = RNAi agent antisense strand 19-mer core base sequence
  source 1..19: mol_type = other RNA
tatttctacttcagagcaa

SEQ ID NO: 189 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
natttctacttcagagcaa

SEQ ID NO: 190 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
natttctacttcagagcan

SEQ ID NO: 191 - RNA, 19 nt, synthetic construct
  misc_feature 1..19: note = RNAi agent antisense strand 19-mer core base sequence
  source 1..19: mol_type = other RNA
tgtccaatatcaatggcag

SEQ ID NO: 192 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtccaatatcaatggcag

SEQ ID NO: 193 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtccaatatcaatggcan

SEQ ID NO: 194 - RNA, 19 nt, synthetic construct
  misc_feature 1..19: note = RNAi agent antisense strand 19-mer core base sequence
  source 1..19: mol_type = other RNA
tcagaaaagtggacgatct

SEQ ID NO: 195 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncagaaaagtggacgatct

SEQ ID NO: 196 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncagaaaagtggacgatcn

SEQ ID NO: 197 - RNA, 19 nt, synthetic construct
  misc_feature 1..19: note = RNAi agent antisense strand 19-mer core base sequence
  source 1..19: mol_type = other RNA
acaacattatctgcttcgg

SEQ ID NO: 198 - RNA, 19 nt, synthetic construct
  misc_feature 1..19: note = RNAi agent antisense strand 19-mer core base sequence
  source 1..19: mol_type = other RNA
tcaacattatctgcttcgg

SEQ ID NO: 199 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaacattatctgcttcgg

SEQ ID NO: 200 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaacattatctgcttcgn

SEQ ID NO: 201 - RNA, 19 nt, synthetic construct
  misc_feature 1..19: note = RNAi agent antisense strand 19-mer core base sequence
  source 1..19: mol_type = other RNA
tcataatactctgagagag

SEQ ID NO: 202 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncataatactctgagagag

SEQ ID NO: 203 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncataatactctgagagan

SEQ ID NO: 204 - RNA, 19 nt, synthetic construct
  misc_feature 1..19: note = RNAi agent antisense strand 19-mer core base sequence
  source 1..19: mol_type = other RNA
tcttattccaaacttggtg

SEQ ID NO: 205 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncttattccaaacttggtg

SEQ ID NO: 206 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncttattccaaacttggtn

SEQ ID NO: 207 - RNA, 19 nt, synthetic construct
  misc_feature 1..19: note = RNAi agent antisense strand 19-mer core base sequence
  source 1..19: mol_type = other RNA
tagtaatcttgctttatgc

SEQ ID NO: 208 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagtaatcttgctttatgc

SEQ ID NO: 209 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagtaatcttgctttatgn

SEQ ID NO: 210 - RNA, 19 nt, synthetic construct
  misc_feature 1..19: note = RNAi agent antisense strand 19-mer core base sequence
  source 1..19: mol_type = other RNA
aaagaaatctagaacattg

SEQ ID NO: 211 - RNA, 19 nt, synthetic construct
  misc_feature 1..19: note = RNAi agent antisense strand 19-mer core base sequence
  source 1..19: mol_type = other RNA
taagaaatctagaacattg

SEQ ID NO: 212 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naagaaatctagaacattg

SEQ ID NO: 213 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naagaaatctagaacattn

SEQ ID NO: 214 - RNA, 19 nt, synthetic construct
  misc_feature 1..19: note = RNAi agent antisense strand 19-mer core base sequence
  source 1..19: mol_type = other RNA
taacttcactcatccagca

SEQ ID NO: 215 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naacttcactcatccagca

SEQ ID NO: 216 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naacttcactcatccagcn

SEQ ID NO: 217 - RNA, 19 nt, synthetic construct
  misc_feature 1..19: note = RNAi agent antisense strand 19-mer core base sequence
  source 1..19: mol_type = other RNA
tcaacttcactcatccagc

SEQ ID NO: 218 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaacttcactcatccagc

SEQ ID NO: 219 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaacttcactcatccagn

SEQ ID NO: 220 - RNA, 19 nt, synthetic construct
  misc_feature 1..19: note = RNAi agent antisense strand 19-mer core base sequence
  source 1..19: mol_type = other RNA
tgcaacttcactcatccag

SEQ ID NO: 221 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngcaacttcactcatccag

SEQ ID NO: 222 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngcaacttcactcatccan

SEQ ID NO: 223 - RNA, 19 nt, synthetic construct
  misc_feature 1..19: note = RNAi agent antisense strand 19-mer core base sequence
  source 1..19: mol_type = other RNA
tgatcatacttggagagca

SEQ ID NO: 224 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngatcatacttggagagca

SEQ ID NO: 225 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngatcatacttggagagcn

SEQ ID NO: 226 - RNA, 19 nt, synthetic construct
  misc_feature 1..19: note = RNAi agent antisense strand 19-mer core base sequence
  source 1..19: mol_type = other RNA
tcttgttctgcagacgatc

SEQ ID NO: 227 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncttgttctgcagacgatc

SEQ ID NO: 228 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncttgttctgcagacgatc

SEQ ID NO: 229 - RNA, 19 nt, synthetic construct
  misc_feature 1..19: note = RNAi agent antisense strand 19-mer core base sequence
  source 1..19: mol_type = other RNA
tgatcttgttctgcagacg

SEQ ID NO: 230 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngatcttgttctgcagacg

SEQ ID NO: 231 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngatcttgttctgcagacn

SEQ ID NO: 232 - RNA, 19 nt, synthetic construct
  misc_feature 1..19: note = RNAi agent antisense strand 19-mer core base sequence
  source 1..19: mol_type = other RNA
tagtaaagttgcactggcg

SEQ ID NO: 233 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagtaaagttgcactggcg

SEQ ID NO: 234 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagtaaagttgcactggcn

SEQ ID NO: 235 - RNA, 19 nt, synthetic construct
  misc_feature 1..19: note = RNAi agent antisense strand 19-mer core base sequence
  source 1..19: mol_type = other RNA
taacacaagtaaccttatc

SEQ ID NO: 236 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naacacaagtaaccttatc

SEQ ID NO: 237 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naacacaagtaaccttatn

SEQ ID NO: 238 - RNA, 19 nt, synthetic construct
  misc_feature 1..19: note = RNAi agent antisense strand 19-mer core base sequence
  source 1..19: mol_type = other RNA
tcaattgtgataatggctg

SEQ ID NO: 239 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaattgtgataatggctg

SEQ ID NO: 240 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaattgtgataatggctn

SEQ ID NO: 241 - RNA, 19 nt, synthetic construct
  misc_feature 1..19: note = RNAi agent antisense strand 19-mer core base sequence
  source 1..19: mol_type = other RNA
tagcatgatactgagagct

SEQ ID NO: 242 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagcatgatactgagagct

SEQ ID NO: 243 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagcatgatactgagagcn

SEQ ID NO: 244 - RNA, 19 nt, synthetic construct
  misc_feature 1..19: note = RNAi agent antisense strand 19-mer core base sequence
  source 1..19: mol_type = other RNA
aacttgtcaacctcactct

SEQ ID NO: 245 - RNA, 19 nt, synthetic construct
  misc_feature 1..19: note = RNAi agent antisense strand 19-mer core base sequence
  source 1..19: mol_type = other RNA
tacttgtcaacctcactct

SEQ ID NO: 246 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nacttgtcaacctcactct

SEQ ID NO: 247 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nacttgtcaacctcactcn

SEQ ID NO: 248 - RNA, 19 nt, synthetic construct
  misc_feature 1..19: note = RNAi agent antisense strand 19-mer core base sequence
  source 1..19: mol_type = other RNA
taacttgtcaacctcactc

SEQ ID NO: 249 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naacttgtcaacctcactc

SEQ ID NO: 250 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naacttgtcaacctcactn

SEQ ID NO: 251 - RNA, 19 nt, synthetic construct
  misc_feature 1..19: note = RNAi agent antisense strand 19-mer core base sequence
  source 1..19: mol_type = other RNA
taacaattctccttgttga

SEQ ID NO: 252 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naacaattctccttgttga

SEQ ID NO: 253 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naacaattctccttgttgn

SEQ ID NO: 254 - RNA, 19 nt, synthetic construct
  misc_feature 1..19: note = RNAi agent antisense strand 19-mer core base sequence
  source 1..19: mol_type = other RNA
tcatgttctgtggtatgtt

SEQ ID NO: 255 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncatgttctgtggtatgtt

SEQ ID NO: 256 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncatgttctgtggtatgtn

SEQ ID NO: 257 - RNA, 19 nt, synthetic construct
  misc_feature 1..19: note = RNAi agent antisense strand 19-mer core base sequence
  source 1..19: mol_type = other RNA
tactttaatagatccatgt

SEQ ID NO: 258 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nactttaatagatccatgt

SEQ ID NO: 259 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nactttaatagatccatgn

SEQ ID NO: 260 - RNA, 19 nt, synthetic construct
  misc_feature 1..19: note = RNAi agent antisense strand 19-mer core base sequence
  source 1..19: mol_type = other RNA
tgactttaatagatccatg

SEQ ID NO: 261 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngactttaatagatccatg

SEQ ID NO: 262 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngactttaatagatccatn

SEQ ID NO: 263 - RNA, 19 nt, synthetic construct
  misc_feature 1..19: note = RNAi agent antisense strand 19-mer core base sequence
  source 1..19: mol_type = other RNA
tgcatattcaccatttagg

SEQ ID NO: 264 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngcatattcaccatttagg

SEQ ID NO: 265 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngcatattcaccatttagn

SEQ ID NO: 266 - RNA, 19 nt, synthetic construct
  misc_feature 1..19: note = RNAi agent antisense strand 19-mer core base sequence
  source 1..19: mol_type = other RNA
tgtttaagcttctagaggt

SEQ ID NO: 267 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtttaagcttctagaggt

SEQ ID NO: 268 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtttaagcttctagaggn

SEQ ID NO: 269 - RNA, 19 nt, synthetic construct
  misc_feature 1..19: note = RNAi agent antisense strand 19-mer core base sequence
  source 1..19: mol_type = other RNA
ttgttcattggtttgaagg

SEQ ID NO: 270 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgttcattggtttgaagg

SEQ ID NO: 271 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgttcattggtttgaagn

SEQ ID NO: 272 - RNA, 19 nt, synthetic construct
  misc_feature 1..19: note = RNAi agent antisense strand 19-mer core base sequence
  source 1..19: mol_type = other RNA
ttatgctttgctgttcatt

SEQ ID NO: 273 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntatgctttgctgttcatt

SEQ ID NO: 274 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntatgctttgctgttcatn

SEQ ID NO: 275 - RNA, 19 nt, synthetic construct
  misc_feature 1..19: note = RNAi agent antisense strand 19-mer core base sequence
  source 1..19: mol_type = other RNA
tgttatgctttgctgttca

SEQ ID NO: 276 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngttatgctttgctgttca

SEQ ID NO: 277 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngttatgctttgctgttcn

SEQ ID NO: 278 - RNA, 19 nt, synthetic construct
  misc_feature 1..19: note = RNAi agent antisense strand 19-mer core base sequence
  source 1..19: mol_type = other RNA
aggttatgctttgctgttc

SEQ ID NO: 279 - RNA, 19 nt, synthetic construct
  misc_feature 1..19: note = RNAi agent antisense strand 19-mer core base sequence
  source 1..19: mol_type = other RNA
tggttatgctttgctgttc

SEQ ID NO: 280 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nggttatgctttgctgttc

SEQ ID NO: 281 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nggttatgctttgctgttn

SEQ ID NO: 282 - RNA, 19 nt, synthetic construct
  misc_feature 1..19: note = RNAi agent antisense strand 19-mer core base sequence
  source 1..19: mol_type = other RNA
taaggttatgctttgctgt

SEQ ID NO: 283 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naaggttatgctttgctgt

SEQ ID NO: 284 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naaggttatgctttgctgn

SEQ ID NO: 285 - RNA, 19 nt, synthetic construct
  misc_feature 1..19: note = RNAi agent antisense strand 19-mer core base sequence
  source 1..19: mol_type = other RNA
agattcaaggttatgcttt

SEQ ID NO: 286 - RNA, 19 nt, synthetic construct
  misc_feature 1..19: note = RNAi agent antisense strand 19-mer core base sequence
  source 1..19: mol_type = other RNA
tgattcaaggttatgcttt

SEQ ID NO: 287 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngattcaaggttatgcttt

SEQ ID NO: 288 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngattcaaggttatgcttn

SEQ ID NO: 289 - RNA, 19 nt, synthetic construct
  misc_feature 1..19: note = RNAi agent antisense strand 19-mer core base sequence
  source 1..19: mol_type = other RNA
ttcaataattgagttggtt

SEQ ID NO: 290 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntcaataattgagttggtt

SEQ ID NO: 291 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntcaataattgagttggtn

SEQ ID NO: 292 - RNA, 19 nt, synthetic construct
  misc_feature 1..19: note = RNAi agent antisense strand 19-mer core base sequence
  source 1..19: mol_type = other RNA
agtaaaatggatcacagga

SEQ ID NO: 293 - RNA, 19 nt, synthetic construct
  misc_feature 1..19: note = RNAi agent antisense strand 19-mer core base sequence
  source 1..19: mol_type = other RNA
tgtaaaatggatcacagga

SEQ ID NO: 294 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtaaaatggatcacagga

SEQ ID NO: 295 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtaaaatggatcacaggn

SEQ ID NO: 296 - RNA, 19 nt, synthetic construct
  misc_feature 1..19: note = RNAi agent antisense strand 19-mer core base sequence
  source 1..19: mol_type = other RNA
tcatatgacagtaagaaaa

SEQ ID NO: 297 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncatatgacagtaagaaaa

SEQ ID NO: 298 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncatatgacagtaagaaan

SEQ ID NO: 299 - RNA, 19 nt, synthetic construct
  misc_feature 1..19: note = RNAi agent antisense strand 19-mer core base sequence
  source 1..19: mol_type = other RNA
tggatctgcatttttctcc

SEQ ID NO: 300 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nggatctgcatttttctcc

SEQ ID NO: 301 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nggatctgcatttttctcn

SEQ ID NO: 302 - RNA, 19 nt, synthetic construct
  misc_feature 1..19: note = RNAi agent antisense strand 19-mer core base sequence
  source 1..19: mol_type = other RNA
tccaaaagggttgtctctg

SEQ ID NO: 303 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nccaaaagggttgtctctg

SEQ ID NO: 304 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nccaaaagggttgtctctn

SEQ ID NO: 305 - RNA, 19 nt, synthetic construct
  misc_feature 1..19: note = RNAi agent antisense strand 19-mer core base sequence
  source 1..19: mol_type = other RNA
tagacgatcatacttggag

SEQ ID NO: 306 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagacgatcatacttggag

SEQ ID NO: 307 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagacgatcatacttggan

SEQ ID NO: 308 - RNA, 19 nt, synthetic construct
  misc_feature 1..19: note = RNAi agent antisense strand 19-mer core base sequence
  source 1..19: mol_type = other RNA
tcctattccttccacagtt

SEQ ID NO: 309 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncctattccttccacagtt

SEQ ID NO: 310 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncctattccttccacagtn

SEQ ID NO: 311 - RNA, 19 nt, synthetic construct
  misc_feature 1..19: note = RNAi agent antisense strand 19-mer core base sequence
  source 1..19: mol_type = other RNA
tacatactcatgacgatgc

SEQ ID NO: 312 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nacatactcatgacgatgc

SEQ ID NO: 313 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nacatactcatgacgatgn

SEQ ID NO: 314 - RNA, 19 nt, synthetic construct
  misc_feature 1..19: note = RNAi agent antisense strand 19-mer core base sequence
  source 1..19: mol_type = other RNA
tcacagatttccttggaag

SEQ ID NO: 315 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncacagatttccttggaag

SEQ ID NO: 316 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncacagatttccttggaan

SEQ ID NO: 317 - RNA, 19 nt, synthetic construct
  misc_feature 1..19: note = RNAi agent antisense strand 19-mer core base sequence
  source 1..19: mol_type = other RNA
tgaacttcatctcaatgcc

SEQ ID NO: 318 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngaacttcatctcaatgcc

SEQ ID NO: 319 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngaacttcatctcaatgcn

SEQ ID NO: 320 - RNA, 19 nt, synthetic construct
  misc_feature 1..19: note = RNAi agent antisense strand 19-mer core base sequence
  source 1..19: mol_type = other RNA
agcatattcttgaacttca

SEQ ID NO: 321 - RNA, 19 nt, synthetic construct
  misc_feature 1..19: note = RNAi agent antisense strand 19-mer core base sequence
  source 1..19: mol_type = other RNA
tgcatattcttgaacttca

SEQ ID NO: 322 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngcatattcttgaacttca

SEQ ID NO: 323 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngcatattcttgaacttcn

SEQ ID NO: 324 - RNA, 19 nt, synthetic construct
  misc_feature 1..19: note = RNAi agent antisense strand 19-mer core base sequence
  source 1..19: mol_type = other RNA
tcataggaaacagcatatt

SEQ ID NO: 325 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncataggaaacagcatatt

SEQ ID NO: 326 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncataggaaacagcatatn

SEQ ID NO: 327 - RNA, 19 nt, synthetic construct
  misc_feature 1..19: note = RNAi agent antisense strand 19-mer core base sequence
  source 1..19: mol_type = other RNA
tggatctctatggagagca

SEQ ID NO: 328 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nggatctctatggagagca

SEQ ID NO: 329 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nggatctctatggagagcn

SEQ ID NO: 330 - RNA, 19 nt, synthetic construct
  misc_feature 1..19: note = RNAi agent antisense strand 19-mer core base sequence
  source 1..19: mol_type = other RNA
tttgaatgctgagaaatac

SEQ ID NO: 331 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttgaatgctgagaaatac

SEQ ID NO: 332 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttgaatgctgagaaatan

SEQ ID NO: 333 - RNA, 19 nt, synthetic construct
  misc_feature 1..19: note = RNAi agent antisense strand 19-mer core base sequence
  source 1..19: mol_type = other RNA
tctatggacttgatcttgg

SEQ ID NO: 334 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctatggacttgatcttgg

SEQ ID NO: 335 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctatggacttgatcttgn

SEQ ID NO: 336 - RNA, 19 nt, synthetic construct
  misc_feature 1..19: note = RNAi agent antisense strand 19-mer core base sequence
  source 1..19: mol_type = other RNA
atgaaacaaacaaaccctg

SEQ ID NO: 337 - RNA, 19 nt, synthetic construct
  misc_feature 1..19: note = RNAi agent antisense strand 19-mer core base sequence
  source 1..19: mol_type = other RNA
ttgaaacaaacaaaccctg

SEQ ID NO: 338 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgaaacaaacaaaccctg

SEQ ID NO: 339 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgaaacaaacaaaccctn

SEQ ID NO: 340 - RNA, 19 nt, synthetic construct
  misc_feature 1..19: note = RNAi agent antisense strand 19-mer core base sequence
  source 1..19: mol_type = other RNA
tggtagttcttcataggtg

SEQ ID NO: 341 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nggtagttcttcataggtg

SEQ ID NO: 342 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nggtagttcttcataggtn

SEQ ID NO: 343 - RNA, 19 nt, synthetic construct
  misc_feature 1..19: note = RNAi agent antisense strand 19-mer core base sequence
  source 1..19: mol_type = other RNA
tgataatggctggtagttc

SEQ ID NO: 344 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngataatggctggtagttc

SEQ ID NO: 345 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngataatggctggtagttn

SEQ ID NO: 346 - RNA, 19 nt, synthetic construct
  misc_feature 1..19: note = RNAi agent antisense strand 19-mer core base sequence
  source 1..19: mol_type = other RNA
tctcaattgtgataatggc

SEQ ID NO: 347 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctcaattgtgataatggc

SEQ ID NO: 348 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctcaattgtgataatggn

SEQ ID NO: 349 - RNA, 19 nt, synthetic construct
  misc_feature 1..19: note = RNAi agent antisense strand 19-mer core base sequence
  source 1..19: mol_type = other RNA
tctttctcgatcttcagct

SEQ ID NO: 350 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctttctcgatcttcagct

SEQ ID NO: 351 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctttctcgatcttcagcn

SEQ ID NO: 352 - RNA, 19 nt, synthetic construct
  misc_feature 1..19: note = RNAi agent antisense strand 19-mer core base sequence
  source 1..19: mol_type = other RNA
tttggaacagcaatggtgc

SEQ ID NO: 353 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttggaacagcaatggtgc

SEQ ID NO: 354 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttggaacagcaatggtgn

SEQ ID NO: 355 - RNA, 19 nt, synthetic construct
  misc_feature 1..19: note = RNAi agent antisense strand 19-mer core base sequence
  source 1..19: mol_type = other RNA
tgtagacacaaagagctcc

SEQ ID NO: 356 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtagacacaaagagctcc

SEQ ID NO: 357 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtagacacaaagagctcn

SEQ ID NO: 358 - RNA, 19 nt, synthetic construct
  misc_feature 1..19: note = RNAi agent antisense strand 19-mer core base sequence
  source 1..19: mol_type = other RNA
tctgtgtagacacaaagag

SEQ ID NO: 359 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctgtgtagacacaaagag

SEQ ID NO: 360 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctgtgtagacacaaagan

SEQ ID NO: 361 - RNA, 19 nt, synthetic construct
  misc_feature 1..19: note = RNAi agent antisense strand 19-mer core base sequence
  source 1..19: mol_type = other RNA
ttccataatactctgagag

SEQ ID NO: 362 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntccataatactctgagag

SEQ ID NO: 363 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntccataatactctgagan

SEQ ID NO: 364 - RNA, 19 nt, synthetic construct
  misc_feature 1..19: note = RNAi agent antisense strand 19-mer core base sequence
  source 1..19: mol_type = other RNA
tctcgttccataatactct

SEQ ID NO: 365 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nctcgttccataatactct

SEQ ID NO: 366 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nctcgttccataatactcn

SEQ ID NO: 367 - RNA, 19 nt, synthetic construct
  misc_feature 1..19: note = RNAi agent antisense strand 19-mer core base sequence
  source 1..19: mol_type = other RNA
aatgaaacaaacaaaccct

SEQ ID NO: 368 - RNA, 19 nt, synthetic construct
  misc_feature 1..19: note = RNAi agent antisense strand 19-mer core base sequence
  source 1..19: mol_type = other RNA
tatgaaacaaacaaaccct

SEQ ID NO: 369 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
natgaaacaaacaaaccct

SEQ ID NO: 370 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
natgaaacaaacaaacccn

SEQ ID NO: 371 - RNA, 19 nt, synthetic construct
  misc_feature 1..19: note = RNAi agent antisense strand 19-mer core base sequence
  source 1..19: mol_type = other RNA
aaatgaaacaaacaaaccc

SEQ ID NO: 372 - RNA, 19 nt, synthetic construct
  misc_feature 1..19: note = RNAi agent antisense strand 19-mer core base sequence
  source 1..19: mol_type = other RNA
taatgaaacaaacaaaccc

SEQ ID NO: 373 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naatgaaacaaacaaaccc

SEQ ID NO: 374 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naatgaaacaaacaaaccn

SEQ ID NO: 375 - RNA, 19 nt, synthetic construct
  misc_feature 1..19: note = RNAi agent antisense strand 19-mer core base sequence
  source 1..19: mol_type = other RNA
tgaaatgaaacaaacaaac

SEQ ID NO: 376 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngaaatgaaacaaacaaac

SEQ ID NO: 377 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngaaatgaaacaaacaaan

SEQ ID NO: 378 - RNA, 19 nt, synthetic construct
  misc_feature 1..19: note = RNAi agent antisense strand 19-mer core base sequence
  source 1..19: mol_type = other RNA
agacgatcatacttggaga

SEQ ID NO: 379 - RNA, 19 nt, synthetic construct
  misc_feature 1..19: note = RNAi agent antisense strand 19-mer core base sequence
  source 1..19: mol_type = other RNA
tgacgatcatacttggaga

SEQ ID NO: 380 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngacgatcatacttggaga

SEQ ID NO: 381 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngacgatcatacttggagn

SEQ ID NO: 382 - RNA, 19 nt, synthetic construct
  misc_feature 1..19: note = RNAi agent antisense strand 19-mer core base sequence
  source 1..19: mol_type = other RNA
aaggcattctcaatctcct

SEQ ID NO: 383 - RNA, 19 nt, synthetic construct
  misc_feature 1..19: note = RNAi agent antisense strand 19-mer core base sequence
  source 1..19: mol_type = other RNA
taggcattctcaatctcct

SEQ ID NO: 384 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naggcattctcaatctcct

SEQ ID NO: 385 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naggcattctcaatctccn

SEQ ID NO: 386 - RNA, 19 nt, synthetic construct
  misc_feature 1..19: note = RNAi agent antisense strand 19-mer core base sequence
  source 1..19: mol_type = other RNA
tttccttggaaggcattct

SEQ ID NO: 387 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttccttggaaggcattct

SEQ ID NO: 388 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttccttggaaggcattcn

SEQ ID NO: 389 - RNA, 19 nt, synthetic construct
  misc_feature 1..19: note = RNAi agent antisense strand 19-mer core base sequence
  source 1..19: mol_type = other RNA
tagatttccttggaaggca

SEQ ID NO: 390 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagatttccttggaaggca

SEQ ID NO: 391 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagatttccttggaaggcn

SEQ ID NO: 392 - RNA, 19 nt, synthetic construct
  misc_feature 1..19: note = RNAi agent antisense strand 19-mer core base sequence
  source 1..19: mol_type = other RNA
ataggaaacagcatattct

SEQ ID NO: 393 - RNA, 19 nt, synthetic construct
  misc_feature 1..19: note = RNAi agent antisense strand 19-mer core base sequence
  source 1..19: mol_type = other RNA
ttaggaaacagcatattct

SEQ ID NO: 394 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntaggaaacagcatattct

SEQ ID NO: 395 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntaggaaacagcatattcn

SEQ ID NO: 396 - RNA, 19 nt, synthetic construct
  misc_feature 1..19: note = RNAi agent antisense strand 19-mer core base sequence
  source 1..19: mol_type = other RNA
ttgatgatgttccctccaa

SEQ ID NO: 397 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgatgatgttccctccaa

SEQ ID NO: 398 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgatgatgttccctccan

SEQ ID NO: 399 - RNA, 19 nt, synthetic construct
  misc_feature 1..19: note = RNAi agent antisense strand 19-mer core base sequence
  source 1..19: mol_type = other RNA
tagaacttgaagaagaagc

SEQ ID NO: 400 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagaacttgaagaagaagc

SEQ ID NO: 401 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagaacttgaagaagaagn

SEQ ID NO: 402 - RNA, 19 nt, synthetic construct
  misc_feature 1..19: note = RNAi agent antisense strand 19-mer core base sequence
  source 1..19: mol_type = other RNA
taccaatgatatgcccaac

SEQ ID NO: 403 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naccaatgatatgcccaac

SEQ ID NO: 404 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naccaatgatatgcccaan

SEQ ID NO: 405 - RNA, 19 nt, synthetic construct
  misc_feature 1..19: note = RNAi agent antisense strand 19-mer core base sequence
  source 1..19: mol_type = other RNA
tcatggtgttctgtgtaga

SEQ ID NO: 406 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncatggtgttctgtgtaga

SEQ ID NO: 407 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncatggtgttctgtgtagn

SEQ ID NO: 408 - RNA, 19 nt, synthetic construct
  misc_feature 1..19: note = RNAi agent antisense strand 19-mer core base sequence
  source 1..19: mol_type = other RNA
ttgagagagatcctgggtg

SEQ ID NO: 409 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgagagagatcctgggtg

SEQ ID NO: 410 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgagagagatcctgggtn

SEQ ID NO: 411 - RNA, 19 nt, synthetic construct
  misc_feature 1..19: note = RNAi agent antisense strand 19-mer core base sequence
  source 1..19: mol_type = other RNA
tcatgatactgagagcttg

SEQ ID NO: 412 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncatgatactgagagcttg

SEQ ID NO: 413 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncatgatactgagagcttn

SEQ ID NO: 414 - RNA, 19 nt, synthetic construct
  misc_feature 1..19: note = RNAi agent antisense strand 19-mer core base sequence
  source 1..19: mol_type = other RNA
ttgtcaacctcactcttcc

SEQ ID NO: 415 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgtcaacctcactcttcc

SEQ ID NO: 416 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgtcaacctcactcttcn

SEQ ID NO: 417 - RNA, 19 nt, synthetic construct
  misc_feature 1..19: note = RNAi agent antisense strand 19-mer core base sequence
  source 1..19: mol_type = other RNA
tttccaacaattctccttg

SEQ ID NO: 418 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttccaacaattctccttg

SEQ ID NO: 419 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttccaacaattctccttn

SEQ ID NO: 420 - RNA, 19 nt, synthetic construct
  misc_feature 1..19: note = RNAi agent antisense strand 19-mer core base sequence
  source 1..19: mol_type = other RNA
ttgagttagtctcaaagct

SEQ ID NO: 421 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgagttagtctcaaagct

SEQ ID NO: 422 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgagttagtctcaaagcn

SEQ ID NO: 423 - RNA, 19 nt, synthetic construct
  misc_feature 1..19: note = RNAi agent antisense strand 19-mer core base sequence
  source 1..19: mol_type = other RNA
atgacaatatctgtgcgga

SEQ ID NO: 424 - RNA, 19 nt, synthetic construct
  misc_feature 1..19: note = RNAi agent antisense strand 19-mer core base sequence
  source 1..19: mol_type = other RNA
ttgacaatatctgtgcgga

SEQ ID NO: 425 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgacaatatctgtgcgga

SEQ ID NO: 426 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgacaatatctgtgcggn

SEQ ID NO: 427 - RNA, 19 nt, synthetic construct
  misc_feature 1..19: note = RNAi agent antisense strand 19-mer core base sequence
  source 1..19: mol_type = other RNA
tcatgacaatatctgtgcg

SEQ ID NO: 428 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncatgacaatatctgtgcg

SEQ ID NO: 429 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncatgacaatatctgtgcn

SEQ ID NO: 430 - RNA, 19 nt, synthetic construct
  misc_feature 1..19: note = RNAi agent antisense strand 19-mer core base sequence
  source 1..19: mol_type = other RNA
tcaaagaagatagaagcag

SEQ ID NO: 431 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaaagaagatagaagcag

SEQ ID NO: 432 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaaagaagatagaagcan

SEQ ID NO: 433 - RNA, 19 nt, synthetic construct
  misc_feature 1..19: note = RNAi agent antisense strand 19-mer core base sequence
  source 1..19: mol_type = other RNA
tcacgttattacctgtgtg

SEQ ID NO: 434 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncacgttattacctgtgtg

SEQ ID NO: 435 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncacgttattacctgtgtn

SEQ ID NO: 436 - RNA, 19 nt, synthetic construct
  misc_feature 1..19: note = RNAi agent antisense strand 19-mer core base sequence
  source 1..19: mol_type = other RNA
tagaacttgaggttataca

SEQ ID NO: 437 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagaacttgaggttataca

SEQ ID NO: 438 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagaacttgaggttatacn

SEQ ID NO: 439 - RNA, 19 nt, synthetic construct
  misc_feature 1..19: note = RNAi agent antisense strand 19-mer core base sequence
  source 1..19: mol_type = other RNA
atgctttgctgttcattgg

SEQ ID NO: 440 - RNA, 19 nt, synthetic construct
  misc_feature 1..19: note = RNAi agent antisense strand 19-mer core base sequence
  source 1..19: mol_type = other RNA
ttgctttgctgttcattgg

SEQ ID NO: 441 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgctttgctgttcattgg

SEQ ID NO: 442 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgctttgctgttcattgn

SEQ ID NO: 443 - RNA, 19 nt, synthetic construct
  misc_feature 1..19: note = RNAi agent antisense strand 19-mer core base sequence
  source 1..19: mol_type = other RNA
tagtatagattcaaggtta

SEQ ID NO: 444 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagtatagattcaaggtta

SEQ ID NO: 445 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagtatagattcaaggttn

SEQ ID NO: 446 - RNA, 19 nt, synthetic construct
  misc_feature 1..19: note = RNAi agent antisense strand 19-mer core base sequence
  source 1..19: mol_type = other RNA
agagtaatcttgctttatg

SEQ ID NO: 447 - RNA, 19 nt, synthetic construct
  misc_feature 1..19: note = RNAi agent antisense strand 19-mer core base sequence
  source 1..19: mol_type = other RNA
tgagtaatcttgctttatg

SEQ ID NO: 448 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngagtaatcttgctttatg

SEQ ID NO: 449 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngagtaatcttgctttatn

SEQ ID NO: 450 - RNA, 19 nt, synthetic construct
  misc_feature 1..19: note = RNAi agent antisense strand 19-mer core base sequence
  source 1..19: mol_type = other RNA
atagcatcatttctaggtg

SEQ ID NO: 451 - RNA, 19 nt, synthetic construct
  misc_feature 1..19: note = RNAi agent antisense strand 19-mer core base sequence
  source 1..19: mol_type = other RNA
ttagcatcatttctaggtg

SEQ ID NO: 452 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntagcatcatttctaggtg

SEQ ID NO: 453 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntagcatcatttctaggtn

SEQ ID NO: 454 - RNA, 19 nt, synthetic construct
  misc_feature 1..19: note = RNAi agent antisense strand 19-mer core base sequence
  source 1..19: mol_type = other RNA
agacagaagagacagagct

SEQ ID NO: 455 - RNA, 19 nt, synthetic construct
  misc_feature 1..19: note = RNAi agent antisense strand 19-mer core base sequence
  source 1..19: mol_type = other RNA
tgacagaagagacagagct

SEQ ID NO: 456 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngacagaagagacagagct

SEQ ID NO: 457 - DNA, 19 bp, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other DNA
ngacagaagagacagagcn

SEQ ID NO: 458 - RNA, 19 nt, synthetic construct
  misc_feature 1..19: note = RNAi agent antisense strand 19-mer core base sequence
  source 1..19: mol_type = other RNA
agtaagaaaaccaagcctt

SEQ ID NO: 459 - RNA, 19 nt, synthetic construct
  misc_feature 1..19: note = RNAi agent antisense strand 19-mer core base sequence
  source 1..19: mol_type = other RNA
tgtaagaaaaccaagcctt

SEQ ID NO: 460 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtaagaaaaccaagcctt

SEQ ID NO: 461 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtaagaaaaccaagcctn

SEQ ID NO: 462 - RNA, 19 nt, synthetic construct
  misc_feature 1..19: note = RNAi agent antisense strand 19-mer core base sequence
  source 1..19: mol_type = other RNA
agtaagaaaaccaagcctt

SEQ ID NO: 463 - RNA, 19 nt, synthetic construct
  misc_feature 1..19: note = RNAi agent antisense strand 19-mer core base sequence
  source 1..19: mol_type = other RNA
tgtaagaaaaccaagcctt

SEQ ID NO: 464 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngtaagaaaaccaagcctt

SEQ ID NO: 465 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngtaagaaaaccaagcctn

SEQ ID NO: 466 - RNA, 19 nt, synthetic construct
  misc_feature 1..19: note = RNAi agent antisense strand 19-mer core base sequence
  source 1..19: mol_type = other RNA
tatacttggagagcatcac

SEQ ID NO: 467 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
natacttggagagcatcac

SEQ ID NO: 468 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
natacttggagagcatcan

SEQ ID NO: 469 - RNA, 19 nt, synthetic construct
  misc_feature 1..19: note = RNAi agent antisense strand 19-mer core base sequence
  source 1..19: mol_type = other RNA
ttgcagacgatcatacttg

SEQ ID NO: 470 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgcagacgatcatacttg

SEQ ID NO: 471 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgcagacgatcatacttn

SEQ ID NO: 472 - RNA, 19 nt, synthetic construct
  misc_feature 1..19: note = RNAi agent antisense strand 19-mer core base sequence
  source 1..19: mol_type = other RNA
ttgaataaaactctcatgc

SEQ ID NO: 473 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgaataaaactctcatgc

SEQ ID NO: 474 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgaataaaactctcatgn

SEQ ID NO: 475 - RNA, 19 nt, synthetic construct
  misc_feature 1..19: note = RNAi agent antisense strand 19-mer core base sequence
  source 1..19: mol_type = other RNA
ttgaataaaactctcatgc

SEQ ID NO: 476 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntgaataaaactctcatgc

SEQ ID NO: 477 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntgaataaaactctcatgn

SEQ ID NO: 478 - RNA, 19 nt, synthetic construct
  misc_feature 1..19: note = RNAi agent antisense strand 19-mer core base sequence
  source 1..19: mol_type = other RNA
agaaaagtggacgatcttg

SEQ ID NO: 479 - RNA, 19 nt, synthetic construct
  misc_feature 1..19: note = RNAi agent antisense strand 19-mer core base sequence
  source 1..19: mol_type = other RNA
tgaaaagtggacgatcttg

SEQ ID NO: 480 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngaaaagtggacgatcttg

SEQ ID NO: 481 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngaaaagtggacgatcttn

SEQ ID NO: 482 - RNA, 19 nt, synthetic construct
  misc_feature 1..19: note = RNAi agent antisense strand 19-mer core base sequence
  source 1..19: mol_type = other RNA
tagttgtcactgcaacatg

SEQ ID NO: 483 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nagttgtcactgcaacatg

SEQ ID NO: 484 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nagttgtcactgcaacatn

SEQ ID NO: 485 - RNA, 19 nt, synthetic construct
  misc_feature 1..19: note = RNAi agent antisense strand 19-mer core base sequence
  source 1..19: mol_type = other RNA
attccttccacagttgtca

SEQ ID NO: 486 - RNA, 19 nt, synthetic construct
  misc_feature 1..19: note = RNAi agent antisense strand 19-mer core base sequence
  source 1..19: mol_type = other RNA
tttccttccacagttgtca

SEQ ID NO: 487 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttccttccacagttgtca

SEQ ID NO: 488 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttccttccacagttgtcn

SEQ ID NO: 489 - RNA, 19 nt, synthetic construct
  misc_feature 1..19: note = RNAi agent antisense strand 19-mer core base sequence
  source 1..19: mol_type = other RNA
tgcattctcaatctcctcc

SEQ ID NO: 490 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngcattctcaatctcctcc

SEQ ID NO: 491 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngcattctcaatctcctcn

SEQ ID NO: 492 - RNA, 19 nt, synthetic construct
  misc_feature 1..19: note = RNAi agent antisense strand 19-mer core base sequence
  source 1..19: mol_type = other RNA
ttcaatgccaatctccgtg

SEQ ID NO: 493 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntcaatgccaatctccgtg

SEQ ID NO: 494 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntcaatgccaatctccgtn

SEQ ID NO: 495 - RNA, 19 nt, synthetic construct
  misc_feature 1..19: note = RNAi agent antisense strand 19-mer core base sequence
  source 1..19: mol_type = other RNA
atattcttgaacttcatct

SEQ ID NO: 496 - RNA, 19 nt, synthetic construct
  misc_feature 1..19: note = RNAi agent antisense strand 19-mer core base sequence
  source 1..19: mol_type = other RNA
ttattcttgaacttcatct

SEQ ID NO: 497 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntattcttgaacttcatct

SEQ ID NO: 498 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntattcttgaacttcatcn

SEQ ID NO: 499 - RNA, 19 nt, synthetic construct
  misc_feature 1..19: note = RNAi agent antisense strand 19-mer core base sequence
  source 1..19: mol_type = other RNA
atattcttgaacttcatct

SEQ ID NO: 500 - RNA, 19 nt, synthetic construct
  misc_feature 1..19: note = RNAi agent antisense strand 19-mer core base sequence
  source 1..19: mol_type = other RNA
ttattcttgaacttcatct

SEQ ID NO: 501 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntattcttgaacttcatct

SEQ ID NO: 502 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntattcttgaacttcatcn

SEQ ID NO: 503 - RNA, 19 nt, synthetic construct
  misc_feature 1..19: note = RNAi agent antisense strand 19-mer core base sequence
  source 1..19: mol_type = other RNA
ttatggagagcagtatctc

SEQ ID NO: 504 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntatggagagcagtatctc

SEQ ID NO: 505 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntatggagagcagtatctn

SEQ ID NO: 506 - RNA, 19 nt, synthetic construct
  misc_feature 1..19: note = RNAi agent antisense strand 19-mer core base sequence
  source 1..19: mol_type = other RNA
taatgctgagaaatactcc

SEQ ID NO: 507 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
naatgctgagaaatactcc

SEQ ID NO: 508 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
naatgctgagaaatactcn

SEQ ID NO: 509 - RNA, 19 nt, synthetic construct
  misc_feature 1..19: note = RNAi agent antisense strand 19-mer core base sequence
  source 1..19: mol_type = other RNA
tgaatgctgagaaatactc

SEQ ID NO: 510 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ngaatgctgagaaatactc

SEQ ID NO: 511 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ngaatgctgagaaatactn

SEQ ID NO: 512 - RNA, 19 nt, synthetic construct
  misc_feature 1..19: note = RNAi agent antisense strand 19-mer core base sequence
  source 1..19: mol_type = other RNA
tcaatgtcatcttctctcc

SEQ ID NO: 513 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaatgtcatcttctctcc

SEQ ID NO: 514 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaatgtcatcttctctcn

SEQ ID NO: 515 - RNA, 19 nt, synthetic construct
  misc_feature 1..19: note = RNAi agent antisense strand 19-mer core base sequence
  source 1..19: mol_type = other RNA
acaaattccagttatgtta

SEQ ID NO: 516 - RNA, 19 nt, synthetic construct
  misc_feature 1..19: note = RNAi agent antisense strand 19-mer core base sequence
  source 1..19: mol_type = other RNA
tcaaattccagttatgtta

SEQ ID NO: 517 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaaattccagttatgtta

SEQ ID NO: 518 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaaattccagttatgttn

SEQ ID NO: 519 - RNA, 19 nt, synthetic construct
  misc_feature 1..19: note = RNAi agent antisense strand 19-mer core base sequence
  source 1..19: mol_type = other RNA
ttcaattgtgataatggct

SEQ ID NO: 520 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntcaattgtgataatggct

SEQ ID NO: 521 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntcaattgtgataatggcn

SEQ ID NO: 522 - RNA, 19 nt, synthetic construct
  misc_feature 1..19: note = RNAi agent antisense strand 19-mer core base sequence
  source 1..19: mol_type = other RNA
aacatttttgcaacaaagc

SEQ ID NO: 523 - RNA, 19 nt, synthetic construct
  misc_feature 1..19: note = RNAi agent antisense strand 19-mer core base sequence
  source 1..19: mol_type = other RNA
tacatttttgcaacaaagc

SEQ ID NO: 524 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nacatttttgcaacaaagc

SEQ ID NO: 525 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nacatttttgcaacaaagn

SEQ ID NO: 526 - RNA, 19 nt, synthetic construct
  misc_feature 1..19: note = RNAi agent antisense strand 19-mer core base sequence
  source 1..19: mol_type = other RNA
tcaacatttttgcaacaaa

SEQ ID NO: 527 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ncaacatttttgcaacaaa

SEQ ID NO: 528 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ncaacatttttgcaacaan

SEQ ID NO: 529 - RNA, 19 nt, synthetic construct
  misc_feature 1..19: note = RNAi agent antisense strand 19-mer core base sequence
  source 1..19: mol_type = other RNA
tttcactcgaaccacaatc

SEQ ID NO: 530 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
nttcactcgaaccacaatc

SEQ ID NO: 531 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
nttcactcgaaccacaatn

SEQ ID NO: 532 - RNA, 19 nt, synthetic construct
  misc_feature 1..19: note = RNAi agent antisense strand 19-mer core base sequence
  source 1..19: mol_type = other RNA
ttggaaggcattctcaatc

SEQ ID NO: 533 - RNA, 19 nt, synthetic construct
  misc_feature 1..19: note = RNAi agent antisense strand 19-mer core base sequence
  misc_difference 1: note = a, c, u, g, unknown or other
  source 1..19: mol_type = other RNA
ntggaaggcattctcaatc

SEQ ID NO: 534 - RNA, 19 nt, synthetic construct
  misc_feature 1..19: note = RNAi agent antisense strand 19-mer core base sequence
  misc_difference 1: note = a, c, u, g, unknown or other
  misc_difference 19: note = a, c, u, g, unknown or other
  source 1..19: mol_type = other RNA
ntggaaggcattctcaatn

SEQ ID NO: 535 - RNA, 19 nt, synthetic construct
  misc_feature 1..19: note = RNAi agent sense strand 19-mer core base sequence
  source 1..19: mol_type = other RNA
tcagcttcttcttcaagtt

SEQ ID NO: 536 - RNA, 19 nt, synthetic construct
  misc_feature 1..19: note = RNAi agent sense strand 19-mer core base sequence
  source 1..19: mol_type = other RNA
tcagcttcttcttcaagta

SEQ ID NO: 537 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tcagcttcttcttcaagtn

SEQ ID NO: 538 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncagcttcttcttcaagtn

SEQ ID NO: 539 - RNA, 19 nt, synthetic construct
  misc_feature 1..19: note = RNAi agent sense strand 19-mer core base sequence
  source 1..19: mol_type = other RNA
agcttcttcttcaagttct

SEQ ID NO: 540 - RNA, 19 nt, synthetic construct
  misc_feature 1..19: note = RNAi agent sense strand 19-mer core base sequence
  source 1..19: mol_type = other RNA
agcttcttcttcaagttca

SEQ ID NO: 541 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agcttcttcttcaagttcn

SEQ ID NO: 542 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngcttcttcttcaagttcn

SEQ ID NO: 543 - RNA, 19 nt, synthetic construct
  misc_feature 1..19: note = RNAi agent sense strand 19-mer core base sequence
  source 1..19: mol_type = other RNA
ttcttcttcaagttctaca

SEQ ID NO: 544 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ttcttcttcaagttctacn

SEQ ID NO: 545 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntcttcttcaagttctacn

SEQ ID NO: 546 - RNA, 19 nt, synthetic construct
  misc_feature 1..19: note = RNAi agent sense strand 19-mer core base sequence
  source 1..19: mol_type = other RNA
gggtgaaaatcacctatga

SEQ ID NO: 547 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gggtgaaaatcacctatgn

SEQ ID NO: 548 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nggtgaaaatcacctatgn

SEQ ID NO: 549 - RNA, 19 nt, synthetic construct
  misc_feature 1..19: note = RNAi agent sense strand 19-mer core base sequence
  source 1..19: mol_type = other RNA
gtgaaaatcacctatgaaa

SEQ ID NO: 550 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gtgaaaatcacctatgaan

SEQ ID NO: 551 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntgaaaatcacctatgaan

SEQ ID NO: 552 - RNA, 19 nt, synthetic construct
  misc_feature 1..19: note = RNAi agent sense strand 19-mer core base sequence
  source 1..19: mol_type = other RNA
tgaaaatcacctatgaaga

SEQ ID NO: 553 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgaaaatcacctatgaagn

SEQ ID NO: 554 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaaaatcacctatgaagn

SEQ ID NO: 555 - RNA, 19 nt, synthetic construct
  misc_feature 1..19: note = RNAi agent sense strand 19-mer core base sequence
  source 1..19: mol_type = other RNA
gaaaatcacctatgaagaa

SEQ ID NO: 556 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gaaaatcacctatgaagan

SEQ ID NO: 557 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naaaatcacctatgaagan

SEQ ID NO: 558 - RNA, 19 nt, synthetic construct
  misc_feature 1..19: note = RNAi agent sense strand 19-mer core base sequence
  source 1..19: mol_type = other RNA
accagccattatcacaatt

SEQ ID NO: 559 - RNA, 19 nt, synthetic construct
  misc_feature 1..19: note = RNAi agent sense strand 19-mer core base sequence
  source 1..19: mol_type = other RNA
accagccattatcacaata

SEQ ID NO: 560 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
accagccattatcacaatn

SEQ ID NO: 561 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nccagccattatcacaatn

SEQ ID NO: 562 - RNA, 19 nt, synthetic construct
  misc_feature 1..19: note = RNAi agent sense strand 19-mer core base sequence
  source 1..19: mol_type = other RNA
agaacaactccttttatga

SEQ ID NO: 563 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agaacaactccttttatgn

SEQ ID NO: 564 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaacaactccttttatgn

SEQ ID NO: 565 - RNA, 19 nt, synthetic construct
  misc_feature 1..19: note = RNAi agent sense strand 19-mer core base sequence
  source 1..19: mol_type = other RNA
gaacaactccttttatgga

SEQ ID NO: 566 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gaacaactccttttatggn

SEQ ID NO: 567 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naacaactccttttatggn

SEQ ID NO: 568 - RNA, 19 nt, synthetic construct
  misc_feature 1..19: note = RNAi agent sense strand 19-mer core base sequence
  source 1..19: mol_type = other RNA
gacaagcactaacactgta

SEQ ID NO: 569 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gacaagcactaacactgtn

SEQ ID NO: 570 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacaagcactaacactgtn

SEQ ID NO: 571 - RNA, 19 nt, synthetic construct
  misc_feature 1..19: note = RNAi agent sense strand 19-mer core base sequence
  source 1..19: mol_type = other RNA
gtcatgagtatgtacacaa

SEQ ID NO: 572 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gtcatgagtatgtacacan

SEQ ID NO: 573 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntcatgagtatgtacacan

SEQ ID NO: 574 - RNA, 19 nt, synthetic construct
  misc_feature 1..19: note = RNAi agent sense strand 19-mer core base sequence
  modified_base 17: mod_base = i
  source 1..19: mol_type = other RNA
gacatgctgataactgnta

SEQ ID NO: 575 - RNA, 19 nt, synthetic construct
  misc_feature 1..19: note = RNAi agent sense strand 19-mer core base sequence
  modified_base 17: mod_base = i
  misc_difference 19: note = a, c, u, g, unknown or other
  source 1..19: mol_type = other RNA
gacatgctgataactgntn

SEQ ID NO: 576 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 17: mod_base = i
  source 1..19: mol_type = other RNA
nacatgctgataactgntn

SEQ ID NO: 577 - RNA, 19 nt, synthetic construct
  misc_feature 1..19: note = RNAi agent sense strand 19-mer core base sequence
  source 1..19: mol_type = other RNA
gacatgctgataactggta

SEQ ID NO: 578 - RNA, 19 nt, synthetic construct
  misc_feature 1..19: note = RNAi agent sense strand 19-mer core base sequence
  source 1..19: mol_type = other RNA
gacatgctgataactggta

SEQ ID NO: 579 - RNA, 19 nt, synthetic construct
  misc_feature 1..19: note = RNAi agent sense strand 19-mer core base sequence
  source 1..19: mol_type = other RNA
gacatgctgataactggta

SEQ ID NO: 580 - RNA, 19 nt, synthetic construct
  misc_feature 1..19: note = RNAi agent sense strand 19-mer core base sequence
  source 1..19: mol_type = other RNA
atacaaggttggcttcata

SEQ ID NO: 581 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
atacaaggttggcttcatn

SEQ ID NO: 582 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntacaaggttggcttcatn

SEQ ID NO: 583 - RNA, 19 nt, synthetic construct
  misc_feature 1..19: note = RNAi agent sense strand 19-mer core base sequence
  source 1..19: mol_type = other RNA
aaggttggcttcatgaaga

SEQ ID NO: 584 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aaggttggcttcatgaagn

SEQ ID NO: 585 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naggttggcttcatgaagn

SEQ ID NO: 586 - RNA, 19 nt, synthetic construct
  misc_feature 1..19: note = RNAi agent sense strand 19-mer core base sequence
  source 1..19: mol_type = other RNA
aggttggcttcatgaagaa

SEQ ID NO: 587 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aggttggcttcatgaagan

SEQ ID NO: 588 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nggttggcttcatgaagan

SEQ ID NO: 589 - RNA, 19 nt, synthetic construct
  misc_feature 1..19: note = RNAi agent sense strand 19-mer core base sequence
  source 1..19: mol_type = other RNA
gttggcttcatgaagacta

SEQ ID NO: 590 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gttggcttcatgaagactn

SEQ ID NO: 591 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nttggcttcatgaagactn

SEQ ID NO: 592 - RNA, 19 nt, synthetic construct
  misc_feature 1..19: note = RNAi agent sense strand 19-mer core base sequence
  source 1..19: mol_type = other RNA
gagaattgttggaaaaaga

SEQ ID NO: 593 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gagaattgttggaaaaagn

SEQ ID NO: 594 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagaattgttggaaaaagn

SEQ ID NO: 595 - RNA, 19 nt, synthetic construct
  misc_feature 1..19: note = RNAi agent sense strand 19-mer core base sequence
  source 1..19: mol_type = other RNA
ggcttgctctgaagtagaa

SEQ ID NO: 596 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggcttgctctgaagtagan

SEQ ID NO: 597 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngcttgctctgaagtagan

SEQ ID NO: 598 - RNA, 19 nt, synthetic construct
  misc_feature 1..19: note = RNAi agent sense strand 19-mer core base sequence
  source 1..19: mol_type = other RNA
ttgctctgaagtagaaata

SEQ ID NO: 599 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ttgctctgaagtagaaatn

SEQ ID NO: 600 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntgctctgaagtagaaatn

SEQ ID NO: 601 - RNA, 19 nt, synthetic construct
  misc_feature 1..19: note = RNAi agent sense strand 19-mer core base sequence
  modified_base 15: mod_base = i
  source 1..19: mol_type = other RNA
ctgccattgatattngaca

SEQ ID NO: 602 - RNA, 19 nt, synthetic construct
  misc_feature 1..19: note = RNAi agent sense strand 19-mer core base sequence
  modified_base 15: mod_base = i
  misc_difference 19: note = a, c, u, g, unknown or other
  source 1..19: mol_type = other RNA
ctgccattgatattngacn

SEQ ID NO: 603 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 15: mod_base = i
  source 1..19: mol_type = other RNA
ntgccattgatattngacn

SEQ ID NO: 604 - RNA, 19 nt, synthetic construct
  misc_feature 1..19: note = RNAi agent sense strand 19-mer core base sequence
  source 1..19: mol_type = other RNA
agatcgtccacttttctga

SEQ ID NO: 605 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agatcgtccacttttctgn

SEQ ID NO: 606 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngatcgtccacttttctgn

SEQ ID NO: 607 - RNA, 19 nt, synthetic construct
  misc_feature 1..19: note = RNAi agent sense strand 19-mer core base sequence
  source 1..19: mol_type = other RNA
ccgaagcagataatgttgt

SEQ ID NO: 608 - RNA, 19 nt, synthetic construct
  misc_feature 1..19: note = RNAi agent sense strand 19-mer core base sequence
  source 1..19: mol_type = other RNA
ccgaagcagataatgttgt

SEQ ID NO: 609 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ccgaagcagataatgttgn

SEQ ID NO: 610 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncgaagcagataatgttgn

SEQ ID NO: 611 - RNA, 19 nt, synthetic construct
  misc_feature 1..19: note = RNAi agent sense strand 19-mer core base sequence
  source 1..19: mol_type = other RNA
ctctctcagagtattatga

SEQ ID NO: 612 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ctctctcagagtattatgn

SEQ ID NO: 613 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntctctcagagtattatgn

SEQ ID NO: 614 - RNA, 19 nt, synthetic construct
  misc_feature 1..19: note = RNAi agent sense strand 19-mer core base sequence
  source 1..19: mol_type = other RNA
caccaagtttggaataaga

SEQ ID NO: 615 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
caccaagtttggaataagn

SEQ ID NO: 616 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naccaagtttggaataagn

SEQ ID NO: 617 - RNA, 19 nt, synthetic construct
  misc_feature 1..19: note = RNAi agent sense strand 19-mer core base sequence
  source 1..19: mol_type = other RNA
gcataaagcaagattacta

SEQ ID NO: 618 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gcataaagcaagattactn

SEQ ID NO: 619 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncataaagcaagattactn

SEQ ID NO: 620 - RNA, 19 nt, synthetic construct
  misc_feature 1..19: note = RNAi agent sense strand 19-mer core base sequence
  source 1..19: mol_type = other RNA
caatgttctagatttcttt

SEQ ID NO: 621 - RNA, 19 nt, synthetic construct
  misc_feature 1..19: note = RNAi agent sense strand 19-mer core base sequence
  source 1..19: mol_type = other RNA
caatgttctagatttctta

SEQ ID NO: 622 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
caatgttctagatttcttn

SEQ ID NO: 623 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naatgttctagatttcttn

SEQ ID NO: 624 - RNA, 19 nt, synthetic construct
  misc_feature 1..19: note = RNAi agent sense strand 19-mer core base sequence
  source 1..19: mol_type = other RNA
tgctggatgagtgaagtta

SEQ ID NO: 625 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgctggatgagtgaagttn

SEQ ID NO: 626 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngctggatgagtgaagttn

SEQ ID NO: 627 - RNA, 19 nt, synthetic construct
  misc_feature 1..19: note = RNAi agent sense strand 19-mer core base sequence
  modified_base 4: mod_base = i
  source 1..19: mol_type = other RNA
gctngatgagtgaagttga

SEQ ID NO: 628 - RNA, 19 nt, synthetic construct
  misc_feature 1..19: note = RNAi agent sense strand 19-mer core base sequence
  modified_base 4: mod_base = i
  misc_difference 19: note = a, c, u, g, unknown or other
  source 1..19: mol_type = other RNA
gctngatgagtgaagttgn

SEQ ID NO: 629 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 4: mod_base = i
  source 1..19: mol_type = other RNA
nctngatgagtgaagttgn

SEQ ID NO: 630 - RNA, 19 nt, synthetic construct
  misc_feature 1..19: note = RNAi agent sense strand 19-mer core base sequence
  modified_base 17: mod_base = i
  source 1..19: mol_type = other RNA
ctggatgagtgaagttnca

SEQ ID NO: 631 - RNA, 19 nt, synthetic construct
  misc_feature 1..19: note = RNAi agent sense strand 19-mer core base sequence
  modified_base 17: mod_base = i
  misc_difference 19: note = a, c, u, g, unknown or other
  source 1..19: mol_type = other RNA
ctggatgagtgaagttncn

SEQ ID NO: 632 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 17: mod_base = i
  source 1..19: mol_type = other RNA
ntggatgagtgaagttncn

SEQ ID NO: 633 - RNA, 19 nt, synthetic construct
  misc_feature 1..19: note = RNAi agent sense strand 19-mer core base sequence
  source 1..19: mol_type = other RNA
tgctctccaagtatgatca

SEQ ID NO: 634 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgctctccaagtatgatcn

SEQ ID NO: 635 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngctctccaagtatgatcn

SEQ ID NO: 636 - RNA, 19 nt, synthetic construct
  misc_feature 1..19: note = RNAi agent sense strand 19-mer core base sequence
  source 1..19: mol_type = other RNA
gatcgtctgcagaacaaga

SEQ ID NO: 637 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gatcgtctgcagaacaagn

SEQ ID NO: 638 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gatcgtctgcagaacaagn

SEQ ID NO: 639 - RNA, 19 nt, synthetic construct
  misc_feature 1..19: note = RNAi agent sense strand 19-mer core base sequence
  source 1..19: mol_type = other RNA
cgtctgcagaacaagatca

SEQ ID NO: 640 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cgtctgcagaacaagatcn

SEQ ID NO: 641 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngtctgcagaacaagatcn

SEQ ID NO: 642 - RNA, 19 nt, synthetic construct
  misc_feature 1..19: note = RNAi agent sense strand 19-mer core base sequence
  source 1..19: mol_type = other RNA
cgccagtgcaactttacta

SEQ ID NO: 643 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cgccagtgcaactttactn

SEQ ID NO: 644 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngccagtgcaactttactn

SEQ ID NO: 645 - RNA, 19 nt, synthetic construct
  misc_feature 1..19: note = RNAi agent sense strand 19-mer core base sequence
  source 1..19: mol_type = other RNA
gataaggttacttgtgtta

SEQ ID NO: 646 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gataaggttacttgtgttn

SEQ ID NO: 647 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nataaggttacttgtgttn

SEQ ID NO: 648 - RNA, 19 nt, synthetic construct
  misc_feature 1..19: note = RNAi agent sense strand 19-mer core base sequence
  source 1..19: mol_type = other RNA
cagccattatcacaattga

SEQ ID NO: 649 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cagccattatcacaattgn

SEQ ID NO: 650 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagccattatcacaattgn

SEQ ID NO: 651 - RNA, 19 nt, synthetic construct
  misc_feature 1..19: note = RNAi agent sense strand 19-mer core base sequence
  source 1..19: mol_type = other RNA
agctctcagtatcatgcta

SEQ ID NO: 652 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agctctcagtatcatgctn

SEQ ID NO: 653 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngctctcagtatcatgctn

SEQ ID NO: 654 - RNA, 19 nt, synthetic construct
  misc_feature 1..19: note = RNAi agent sense strand 19-mer core base sequence
  source 1..19: mol_type = other RNA
agagtgaggttgacaagtt

SEQ ID NO: 655 - RNA, 19 nt, synthetic construct
  misc_feature 1..19: note = RNAi agent sense strand 19-mer core base sequence
  source 1..19: mol_type = other RNA
agagtgaggttgacaagta

SEQ ID NO: 656 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agagtgaggttgacaagtn

SEQ ID NO: 657 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngagtgaggttgacaagtn

SEQ ID NO: 658 - RNA, 19 nt, synthetic construct
  misc_feature 1..19: note = RNAi agent sense strand 19-mer core base sequence
  source 1..19: mol_type = other RNA
gagtgaggttgacaagtta

SEQ ID NO: 659 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gagtgaggttgacaagttn

SEQ ID NO: 660 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagtgaggttgacaagttn

SEQ ID NO: 661 - RNA, 19 nt, synthetic construct
  misc_feature 1..19: note = RNAi agent sense strand 19-mer core base sequence
  source 1..19: mol_type = other RNA
tcaacaaggagaattgtta

SEQ ID NO: 662 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tcaacaaggagaattgttn

SEQ ID NO: 663 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncaacaaggagaattgttn

SEQ ID NO: 664 - RNA, 19 nt, synthetic construct
  misc_feature 1..19: note = RNAi agent sense strand 19-mer core base sequence
  source 1..19: mol_type = other RNA
aacataccacagaacatga

SEQ ID NO: 665 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aacataccacagaacatgn

SEQ ID NO: 666 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacataccacagaacatgn

SEQ ID NO: 667 - RNA, 19 nt, synthetic construct
  misc_feature 1..19: note = RNAi agent sense strand 19-mer core base sequence
  source 1..19: mol_type = other RNA
acatggatctattaaagta

SEQ ID NO: 668 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
acatggatctattaaagtn

SEQ ID NO: 669 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncatggatctattaaagtn

SEQ ID NO: 670 - RNA, 19 nt, synthetic construct
  misc_feature 1..19: note = RNAi agent sense strand 19-mer core base sequence
  source 1..19: mol_type = other RNA
catggatctattaaagtca

SEQ ID NO: 671 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
catggatctattaaagtcn

SEQ ID NO: 672 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
natggatctattaaagtcn

SEQ ID NO: 673 - RNA, 19 nt, synthetic construct
  misc_feature 1..19: note = RNAi agent sense strand 19-mer core base sequence
  source 1..19: mol_type = other RNA
cctaaatggtgaatatgca

SEQ ID NO: 674 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cctaaatggtgaatatgcn

SEQ ID NO: 675 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nctaaatggtgaatatgcn

SEQ ID NO: 676 - RNA, 19 nt, synthetic construct
  misc_feature 1..19: note = RNAi agent sense strand 19-mer core base sequence
  source 1..19: mol_type = other RNA
acctctagaagcttaaaca

SEQ ID NO: 677 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
acctctagaagcttaaacn

SEQ ID NO: 678 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncctctagaagcttaaacn

SEQ ID NO: 679 - RNA, 19 nt, synthetic construct
  misc_feature 1..19: note = RNAi agent sense strand 19-mer core base sequence
  source 1..19: mol_type = other RNA
ccttcaaaccaatgaacaa

SEQ ID NO: 680 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ccttcaaaccaatgaacan

SEQ ID NO: 681 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncttcaaaccaatgaacan

SEQ ID NO: 682 - RNA, 19 nt, synthetic construct
  misc_feature 1..19: note = RNAi agent sense strand 19-mer core base sequence
  source 1..19: mol_type = other RNA
aatgaacagcaaagcataa

SEQ ID NO: 683 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aatgaacagcaaagcatan

SEQ ID NO: 684 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
natgaacagcaaagcatan

SEQ ID NO: 685 - RNA, 19 nt, synthetic construct
  misc_feature 1..19: note = RNAi agent sense strand 19-mer core base sequence
  source 1..19: mol_type = other RNA
tgaacagcaaagcataaca

SEQ ID NO: 686 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgaacagcaaagcataacn

SEQ ID NO: 687 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaacagcaaagcataacn

SEQ ID NO: 688 - RNA, 19 nt, synthetic construct
  misc_feature 1..19: note = RNAi agent sense strand 19-mer core base sequence
  source 1..19: mol_type = other RNA
gaacagcaaagcataacct

SEQ ID NO: 689 - RNA, 19 nt, synthetic construct
  misc_feature 1..19: note = RNAi agent sense strand 19-mer core base sequence
  source 1..19: mol_type = other RNA
gaacagcaaagcataacca

SEQ ID NO: 690 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gaacagcaaagcataaccn

SEQ ID NO: 691 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naacagcaaagcataaccn

SEQ ID NO: 692 - RNA, 19 nt, synthetic construct
  misc_feature 1..19: note = RNAi agent sense strand 19-mer core base sequence
  source 1..19: mol_type = other RNA
acagcaaagcataacctta

SEQ ID NO: 693 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
acagcaaagcataaccttn

SEQ ID NO: 694 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncagcaaagcataaccttn

SEQ ID NO: 695 - RNA, 19 nt, synthetic construct
  misc_feature 1..19: note = RNAi agent sense strand 19-mer core base sequence
  source 1..19: mol_type = other RNA
aaagcataaccttgaatct

SEQ ID NO: 696 - RNA, 19 nt, synthetic construct
  misc_feature 1..19: note = RNAi agent sense strand 19-mer core base sequence
  source 1..19: mol_type = other RNA
aaagcataaccttgaatca

SEQ ID NO: 697 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aaagcataaccttgaatcn

SEQ ID NO: 698 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naagcataaccttgaatcn

SEQ ID NO: 699 - RNA, 19 nt, synthetic construct
  misc_feature 1..19: note = RNAi agent sense strand 19-mer core base sequence
  source 1..19: mol_type = other RNA
aaccaactcaattattgaa

SEQ ID NO: 700 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aaccaactcaattattgan

SEQ ID NO: 701 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naccaactcaattattgan

SEQ ID NO: 702 - RNA, 19 nt, synthetic construct
  misc_feature 1..19: note = RNAi agent sense strand 19-mer core base sequence
  source 1..19: mol_type = other RNA
tcctgtgatccattttact

SEQ ID NO: 703 - RNA, 19 nt, synthetic construct
  misc_feature 1..19: note = RNAi agent sense strand 19-mer core base sequence
  source 1..19: mol_type = other RNA
tcctgtgatccattttaca

SEQ ID NO: 704 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tcctgtgatccattttacn

SEQ ID NO: 705 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncctgtgatccattttacn

SEQ ID NO: 706 - RNA, 19 nt, synthetic construct
  misc_feature 1..19: note = RNAi agent sense strand 19-mer core base sequence
  source 1..19: mol_type = other RNA
ttttcttactgtcatatga

SEQ ID NO: 707 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ttttcttactgtcatatgn

SEQ ID NO: 708 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntttcttactgtcatatgn

SEQ ID NO: 709 - RNA, 19 nt, synthetic construct
  misc_feature 1..19: note = RNAi agent sense strand 19-mer core base sequence
  modified_base 14: mod_base = i
  source 1..19: mol_type = other RNA
ggagaaaaatgcanatcca

SEQ ID NO: 710 - RNA, 19 nt, synthetic construct
  misc_feature 1..19: note = RNAi agent sense strand 19-mer core base sequence
  modified_base 14: mod_base = i
  misc_difference 19: note = a, c, u, g, unknown or other
  source 1..19: mol_type = other RNA
ggagaaaaatgcanatccn

SEQ ID NO: 711 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 14: mod_base = i
  source 1..19: mol_type = other RNA
ngagaaaaatgcanatccn

SEQ ID NO: 712 - RNA, 19 nt, synthetic construct
  misc_feature 1..19: note = RNAi agent sense strand 19-mer core base sequence
  source 1..19: mol_type = other RNA
cagagacaactcttttgga

SEQ ID NO: 713 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cagagacaactcttttggn

SEQ ID NO: 714 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagagacaactcttttggn

SEQ ID NO: 715 - RNA, 19 nt, synthetic construct
  misc_feature 1..19: note = RNAi agent sense strand 19-mer core base sequence
  modified_base 15: mod_base = i
  source 1..19: mol_type = other RNA
ctccaagtatgatcntcta

SEQ ID NO: 716 - RNA, 19 nt, synthetic construct
  misc_feature 1..19: note = RNAi agent sense strand 19-mer core base sequence
  modified_base 15: mod_base = i
  misc_difference 19: note = a, c, u, g, unknown or other
  source 1..19: mol_type = other RNA
ctccaagtatgatcntctn

SEQ ID NO: 717 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 15: mod_base = i
  source 1..19: mol_type = other RNA
ntccaagtatgatcntctn

SEQ ID NO: 718 - RNA, 19 nt, synthetic construct
  misc_feature 1..19: note = RNAi agent sense strand 19-mer core base sequence
  source 1..19: mol_type = other RNA
aactgtggaaggaatagga

SEQ ID NO: 719 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aactgtggaaggaataggn

SEQ ID NO: 720 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nactgtggaaggaataggn

SEQ ID NO: 721 - RNA, 19 nt, synthetic construct
  misc_feature 1..19: note = RNAi agent sense strand 19-mer core base sequence
  source 1..19: mol_type = other RNA
gcatcgtcatgagtatgta

SEQ ID NO: 722 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gcatcgtcatgagtatgtn

SEQ ID NO: 723 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncatcgtcatgagtatgtn

SEQ ID NO: 724 - RNA, 19 nt, synthetic construct
  misc_feature 1..19: note = RNAi agent sense strand 19-mer core base sequence
  modified_base 18: mod_base = i
  source 1..19: mol_type = other RNA
cttccaaggaaatctgtna

SEQ ID NO: 725 - RNA, 19 nt, synthetic construct
  misc_feature 1..19: note = RNAi agent sense strand 19-mer core base sequence
  modified_base 18: mod_base = i
  misc_difference 19: note = a, c, u, g, unknown or other
  source 1..19: mol_type = other RNA
cttccaaggaaatctgtnn

SEQ ID NO: 726 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 18: mod_base = i
  source 1..19: mol_type = other RNA
nttccaaggaaatctgtnn

SEQ ID NO: 727 - RNA, 19 nt, synthetic construct
  misc_feature 1..19: note = RNAi agent sense strand 19-mer core base sequence
  source 1..19: mol_type = other RNA
ggcattgagatgaagttca

SEQ ID NO: 728 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggcattgagatgaagttcn

SEQ ID NO: 729 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngcattgagatgaagttcn

SEQ ID NO: 730 - RNA, 19 nt, synthetic construct
  misc_feature 1..19: note = RNAi agent sense strand 19-mer core base sequence
  source 1..19: mol_type = other RNA
tgaagttcaagaatatgct

SEQ ID NO: 731 - RNA, 19 nt, synthetic construct
  misc_feature 1..19: note = RNAi agent sense strand 19-mer core base sequence
  source 1..19: mol_type = other RNA
tgaagttcaagaatatgca

SEQ ID NO: 732 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgaagttcaagaatatgcn

SEQ ID NO: 733 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaagttcaagaatatgcn

SEQ ID NO: 734 - RNA, 19 nt, synthetic construct
  misc_feature 1..19: note = RNAi agent sense strand 19-mer core base sequence
  source 1..19: mol_type = other RNA
aatatgctgtttcctatga

SEQ ID NO: 735 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aatatgctgtttcctatgn

SEQ ID NO: 736 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
natatgctgtttcctatgn

SEQ ID NO: 737 - RNA, 19 nt, synthetic construct
  misc_feature 1..19: note = RNAi agent sense strand 19-mer core base sequence
  modified_base 14: mod_base = i
  source 1..19: mol_type = other RNA
tgctctccataganatcca

SEQ ID NO: 738 - RNA, 19 nt, synthetic construct
  misc_feature 1..19: note = RNAi agent sense strand 19-mer core base sequence
  modified_base 14: mod_base = i
  misc_difference 19: note = a, c, u, g, unknown or other
  source 1..19: mol_type = other RNA
tgctctccataganatccn

SEQ ID NO: 739 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 14: mod_base = i
  source 1..19: mol_type = other RNA
ngctctccataganatccn

SEQ ID NO: 740 - RNA, 19 nt, synthetic construct
  misc_feature 1..19: note = RNAi agent sense strand 19-mer core base sequence
  source 1..19: mol_type = other RNA
gtatttctcagcattcaaa

SEQ ID NO: 741 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gtatttctcagcattcaan

SEQ ID NO: 742 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntatttctcagcattcaan

SEQ ID NO: 743 - RNA, 19 nt, synthetic construct
  misc_feature 1..19: note = RNAi agent sense strand 19-mer core base sequence
  source 1..19: mol_type = other RNA
ccaagatcaagtccataga

SEQ ID NO: 744 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ccaagatcaagtccatagn

SEQ ID NO: 745 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncaagatcaagtccatagn

SEQ ID NO: 746 - RNA, 19 nt, synthetic construct
  misc_feature 1..19: note = RNAi agent sense strand 19-mer core base sequence
  source 1..19: mol_type = other RNA
cagggtttgtttgtttcat

SEQ ID NO: 747 - RNA, 19 nt, synthetic construct
  misc_feature 1..19: note = RNAi agent sense strand 19-mer core base sequence
  source 1..19: mol_type = other RNA
cagggtttgtttgtttcaa

SEQ ID NO: 748 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cagggtttgtttgtttcan

SEQ ID NO: 749 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagggtttgtttgtttcan

SEQ ID NO: 750 - RNA, 19 nt, synthetic construct
  misc_feature 1..19: note = RNAi agent sense strand 19-mer core base sequence
  source 1..19: mol_type = other RNA
cacctatgaagaactacca

SEQ ID NO: 751 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cacctatgaagaactaccn

SEQ ID NO: 752 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacctatgaagaactaccn

SEQ ID NO: 753 - RNA, 19 nt, synthetic construct
  misc_feature 1..19: note = RNAi agent sense strand 19-mer core base sequence
  source 1..19: mol_type = other RNA
gaactaccagccattatca

SEQ ID NO: 754 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gaactaccagccattatcn

SEQ ID NO: 755 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naactaccagccattatcn

SEQ ID NO: 756 - RNA, 19 nt, synthetic construct
  misc_feature 1..19: note = RNAi agent sense strand 19-mer core base sequence
  source 1..19: mol_type = other RNA
gccattatcacaattgaga

SEQ ID NO: 757 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gccattatcacaattgagn

SEQ ID NO: 758 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nccattatcacaattgagn

SEQ ID NO: 759 - RNA, 19 nt, synthetic construct
  misc_feature 1..19: note = RNAi agent sense strand 19-mer core base sequence
  source 1..19: mol_type = other RNA
agctgaagatcgagaaaga

SEQ ID NO: 760 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agctgaagatcgagaaagn

SEQ ID NO: 761 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngctgaagatcgagaaagn

SEQ ID NO: 762 - RNA, 19 nt, synthetic construct
  misc_feature 1..19: note = RNAi agent sense strand 19-mer core base sequence
  source 1..19: mol_type = other RNA
gcaccattgctgttccaaa

SEQ ID NO: 763 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gcaccattgctgttccaan

SEQ ID NO: 764 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncaccattgctgttccaan

SEQ ID NO: 765 - RNA, 19 nt, synthetic construct
  misc_feature 1..19: note = RNAi agent sense strand 19-mer core base sequence
  source 1..19: mol_type = other RNA
ggagctctttgtgtttaca

SEQ ID NO: 766 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggagctctttgtgtttacn

SEQ ID NO: 767 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngagctctttgtgtttacn

SEQ ID NO: 768 - RNA, 19 nt, synthetic construct
  misc_feature 1..19: note = RNAi agent sense strand 19-mer core base sequence
  modified_base 18: mod_base = i
  source 1..19: mol_type = other RNA
ctctttgtgtctacacana

SEQ ID NO: 769 - RNA, 19 nt, synthetic construct
  misc_feature 1..19: note = RNAi agent sense strand 19-mer core base sequence
  modified_base 18: mod_base = i
  misc_difference 19: note = a, c, u, g, unknown or other
  source 1..19: mol_type = other RNA
ctctttgtgtctacacann

SEQ ID NO: 770 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 18: mod_base = i
  source 1..19: mol_type = other RNA
ntctttgtgtctacacann

SEQ ID NO: 771 - RNA, 19 nt, synthetic construct
  misc_feature 1..19: note = RNAi agent sense strand 19-mer core base sequence
  source 1..19: mol_type = other RNA
ctctcagagtattatggaa

SEQ ID NO: 772 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ctctcagagtattatggan

SEQ ID NO: 773 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntctcagagtattatggan

SEQ ID NO: 774 - RNA, 19 nt, synthetic construct
  misc_feature 1..19: note = RNAi agent sense strand 19-mer core base sequence
  modified_base 18: mod_base = i
  source 1..19: mol_type = other RNA
agagtattatggaacgana

SEQ ID NO: 775 - RNA, 19 nt, synthetic construct
  misc_feature 1..19: note = RNAi agent sense strand 19-mer core base sequence
  modified_base 18: mod_base = i
  misc_difference 19: note = a, c, u, g, unknown or other
  source 1..19: mol_type = other RNA
agagtattatggaacgann

SEQ ID NO: 776 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 18: mod_base = i
  source 1..19: mol_type = other RNA
ngagtattatggaacgann

SEQ ID NO: 777 - RNA, 19 nt, synthetic construct
  misc_feature 1..19: note = RNAi agent sense strand 19-mer core base sequence
  source 1..19: mol_type = other RNA
agggtttgtttgtttcatt

SEQ ID NO: 778 - RNA, 19 nt, synthetic construct
  misc_feature 1..19: note = RNAi agent sense strand 19-mer core base sequence
  source 1..19: mol_type = other RNA
agggtttgtttgtttcata

SEQ ID NO: 779 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agggtttgtttgtttcatn

SEQ ID NO: 780 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngggtttgtttgtttcatn

SEQ ID NO: 781 - RNA, 19 nt, synthetic construct
  misc_feature 1..19: note = RNAi agent sense strand 19-mer core base sequence
  source 1..19: mol_type = other RNA
gggtttgtttgtttcattt

SEQ ID NO: 782 - RNA, 19 nt, synthetic construct
  misc_feature 1..19: note = RNAi agent sense strand 19-mer core base sequence
  source 1..19: mol_type = other RNA
gggtttgtttgtttcatta

SEQ ID NO: 783 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gggtttgtttgtttcattn

SEQ ID NO: 784 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nggtttgtttgtttcattn

SEQ ID NO: 785 - RNA, 19 nt, synthetic construct
  misc_feature 1..19: note = RNAi agent sense strand 19-mer core base sequence
  source 1..19: mol_type = other RNA
gtttgtttgtttcatttca

SEQ ID NO: 786 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gtttgtttgtttcatttcn

SEQ ID NO: 787 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntttgtttgtttcatttcn

SEQ ID NO: 788 - RNA, 19 nt, synthetic construct
  misc_feature 1..19: note = RNAi agent sense strand 19-mer core base sequence
  modified_base 16: mod_base = i
  source 1..19: mol_type = other RNA
tctccaagtatgatcntct

SEQ ID NO: 789 - RNA, 19 nt, synthetic construct
  misc_feature 1..19: note = RNAi agent sense strand 19-mer core base sequence
  modified_base 16: mod_base = i
  source 1..19: mol_type = other RNA
tctccaagtatgatcntca

SEQ ID NO: 790 - RNA, 19 nt, synthetic construct
  misc_feature 1..19: note = RNAi agent sense strand 19-mer core base sequence
  modified_base 16: mod_base = i
  misc_difference 19: note = a, c, u, g, unknown or other
  source 1..19: mol_type = other RNA
tctccaagtatgatcntcn

SEQ ID NO: 791 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 16: mod_base = i
  source 1..19: mol_type = other RNA
nctccaagtatgatcntcn

SEQ ID NO: 792 - RNA, 19 nt, synthetic construct
  misc_feature 1..19: note = RNAi agent sense strand 19-mer core base sequence
  modified_base 15: mod_base = i
  source 1..19: mol_type = other RNA
aggagattgagaatncctt

SEQ ID NO: 793 - RNA, 19 nt, synthetic construct
  misc_feature 1..19: note = RNAi agent sense strand 19-mer core base sequence
  modified_base 15: mod_base = i
  source 1..19: mol_type = other RNA
aggagattgagaatnccta

SEQ ID NO: 794 - RNA, 19 nt, synthetic construct
  misc_feature 1..19: note = RNAi agent sense strand 19-mer core base sequence
  modified_base 15: mod_base = i
  misc_difference 19: note = a, c, u, g, unknown or other
  source 1..19: mol_type = other RNA
aggagattgagaatncctn

SEQ ID NO: 795 - RNA, 19 nt, synthetic construct
  misc_feature 1..19: note = RNAi agent sense strand 19-mer core base sequence
  modified_base 15: mod_base = i
  misc_difference 1: note = a, c, u, g, unknown or other
  misc_difference 19: note = a, c, u, g, unknown or other
  source 1..19: mol_type = other RNA
nggagattgagaatncctn

SEQ ID NO: 796 - RNA, 19 nt, synthetic construct
  misc_feature 1..19: note = RNAi agent sense strand 19-mer core base sequence
  source 1..19: mol_type = other RNA
agaatgccttccaaggaaa

SEQ ID NO: 797 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agaatgccttccaaggaan

SEQ ID NO: 798 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaatgccttccaaggaan

SEQ ID NO: 799 - RNA, 19 nt, synthetic construct
  misc_feature 1..19: note = RNAi agent sense strand 19-mer core base sequence
  source 1..19: mol_type = other RNA
tgccttccaaggaaatcta

SEQ ID NO: 800 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgccttccaaggaaatctn

SEQ ID NO: 801 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngccttccaaggaaatctn

SEQ ID NO: 802 - RNA, 19 nt, synthetic construct
  misc_feature 1..19: note = RNAi agent sense strand 19-mer core base sequence
  source 1..19: mol_type = other RNA
agaatatgctgtttcctat

SEQ ID NO: 803 - RNA, 19 nt, synthetic construct
  misc_feature 1..19: note = RNAi agent sense strand 19-mer core base sequence
  source 1..19: mol_type = other RNA
agaatatgctgtttcctaa

SEQ ID NO: 804 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agaatatgctgtttcctan

SEQ ID NO: 805 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaatatgctgtttcctan

SEQ ID NO: 806 - RNA, 19 nt, synthetic construct
  misc_feature 1..19: note = RNAi agent sense strand 19-mer core base sequence
  source 1..19: mol_type = other RNA
ttggagggaacatcatcaa

SEQ ID NO: 807 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ttggagggaacatcatcan

SEQ ID NO: 808 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntggagggaacatcatcan

SEQ ID NO: 809 - RNA, 19 nt, synthetic construct
  misc_feature 1..19: note = RNAi agent sense strand 19-mer core base sequence
  source 1..19: mol_type = other RNA
gcttcttcttcaagttcta

SEQ ID NO: 810 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gcttcttcttcaagttctn

SEQ ID NO: 811 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncttcttcttcaagttctn

SEQ ID NO: 812 - RNA, 19 nt, synthetic construct
  misc_feature 1..19: note = RNAi agent sense strand 19-mer core base sequence
  source 1..19: mol_type = other RNA
gttgggcatatcattggta

SEQ ID NO: 813 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gttgggcatatcattggtn

SEQ ID NO: 814 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nttgggcatatcattggtn

SEQ ID NO: 815 - RNA, 19 nt, synthetic construct
  misc_feature 1..19: note = RNAi agent sense strand 19-mer core base sequence
  source 1..19: mol_type = other RNA
tctacacagaacaccatga

SEQ ID NO: 816 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tctacacagaacaccatgn

SEQ ID NO: 817 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nctacacagaacaccatgn

SEQ ID NO: 818 - RNA, 19 nt, synthetic construct
  misc_feature 1..19: note = RNAi agent sense strand 19-mer core base sequence
  source 1..19: mol_type = other RNA
cacccaggatctctttcaa

SEQ ID NO: 819 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cacccaggatctctttcan

SEQ ID NO: 820 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacccaggatctctttcan

SEQ ID NO: 821 - RNA, 19 nt, synthetic construct
  misc_feature 1..19: note = RNAi agent sense strand 19-mer core base sequence
  source 1..19: mol_type = other RNA
caagctctcagtatcatga

SEQ ID NO: 822 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
caagctctcagtatcatgn

SEQ ID NO: 823 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naagctctcagtatcatgn

SEQ ID NO: 824 - RNA, 19 nt, synthetic construct
  misc_feature 1..19: note = RNAi agent sense strand 19-mer core base sequence
  source 1..19: mol_type = other RNA
ggaagagtgaggttgacaa

SEQ ID NO: 825 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggaagagtgaggttgacan

SEQ ID NO: 826 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaagagtgaggttgacan

SEQ ID NO: 827 - RNA, 19 nt, synthetic construct
  misc_feature 1..19: note = RNAi agent sense strand 19-mer core base sequence
  source 1..19: mol_type = other RNA
caaggagaattgttggaaa

SEQ ID NO: 828 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
caaggagaattgttggaan

SEQ ID NO: 829 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naaggagaattgttggaan

SEQ ID NO: 830 - RNA, 19 nt, synthetic construct
  misc_feature 1..19: note = RNAi agent sense strand 19-mer core base sequence
  source 1..19: mol_type = other RNA
agctttgagactaactcaa

SEQ ID NO: 831 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agctttgagactaactcan

SEQ ID NO: 832 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngctttgagactaactcan

SEQ ID NO: 833 - RNA, 19 nt, synthetic construct
  misc_feature 1..19: note = RNAi agent sense strand 19-mer core base sequence
  source 1..19: mol_type = other RNA
tccgcacagatattgtcat

SEQ ID NO: 834 - RNA, 19 nt, synthetic construct
  misc_feature 1..19: note = RNAi agent sense strand 19-mer core base sequence
  source 1..19: mol_type = other RNA
tccgcacagatattgtcaa

SEQ ID NO: 835 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tccgcacagatattgtcan

SEQ ID NO: 836 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nccgcacagatattgtcan

SEQ ID NO: 837 - RNA, 19 nt, synthetic construct
  misc_feature 1..19: note = RNAi agent sense strand 19-mer core base sequence
  source 1..19: mol_type = other RNA
cgcacagatattgtcatga

SEQ ID NO: 838 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cgcacagatattgtcatgn

SEQ ID NO: 839 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngcacagatattgtcatgn

SEQ ID NO: 840 - RNA, 19 nt, synthetic construct
  misc_feature 1..19: note = RNAi agent sense strand 19-mer core base sequence
  source 1..19: mol_type = other RNA
ctgcttctatcttctttga

SEQ ID NO: 841 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ctgcttctatcttctttgn

SEQ ID NO: 842 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntgcttctatcttctttgn

SEQ ID NO: 843 - RNA, 19 nt, synthetic construct
  misc_feature 1..19: note = RNAi agent sense strand 19-mer core base sequence
  modified_base 18: mod_base = i
  source 1..19: mol_type = other RNA
cacacaggtaataacgtna

SEQ ID NO: 844 - RNA, 19 nt, synthetic construct
  misc_feature 1..19: note = RNAi agent sense strand 19-mer core base sequence
  modified_base 18: mod_base = i
  misc_difference 19: note = a, c, u, g, unknown or other
  source 1..19: mol_type = other RNA
cacacaggtaataacgtnn

SEQ ID NO: 845 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 18: mod_base = i
  source 1..19: mol_type = other RNA
nacacaggtaataacgtnn

SEQ ID NO: 846 - RNA, 19 nt, synthetic construct
  misc_feature 1..19: note = RNAi agent sense strand 19-mer core base sequence
  source 1..19: mol_type = other RNA
tgtataacctcaagttcta

SEQ ID NO: 847 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgtataacctcaagttctn

SEQ ID NO: 848 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngtataacctcaagttctn

SEQ ID NO: 849 - RNA, 19 nt, synthetic construct
  misc_feature 1..19: note = RNAi agent sense strand 19-mer core base sequence
  source 1..19: mol_type = other RNA
ccaatgaacagcaaagcat

SEQ ID NO: 850 - RNA, 19 nt, synthetic construct
  misc_feature 1..19: note = RNAi agent sense strand 19-mer core base sequence
  source 1..19: mol_type = other RNA
ccaatgaacagcaaagcaa

SEQ ID NO: 851 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ccaatgaacagcaaagcan

SEQ ID NO: 852 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncaatgaacagcaaagcan

SEQ ID NO: 853 - RNA, 19 nt, synthetic construct
  misc_feature 1..19: note = RNAi agent sense strand 19-mer core base sequence
  source 1..19: mol_type = other RNA
taaccttgaatctatacta

SEQ ID NO: 854 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
taaccttgaatctatactn

SEQ ID NO: 855 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naaccttgaatctatactn

SEQ ID NO: 856 - RNA, 19 nt, synthetic construct
  misc_feature 1..19: note = RNAi agent sense strand 19-mer core base sequence
  source 1..19: mol_type = other RNA
cataaagcaagattactct

SEQ ID NO: 857 - RNA, 19 nt, synthetic construct
  misc_feature 1..19: note = RNAi agent sense strand 19-mer core base sequence
  source 1..19: mol_type = other RNA
cataaagcaagattactca

SEQ ID NO: 858 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cataaagcaagattactcn

SEQ ID NO: 859 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nataaagcaagattactcn

SEQ ID NO: 860 - RNA, 19 nt, synthetic construct
  misc_feature 1..19: note = RNAi agent sense strand 19-mer core base sequence
  source 1..19: mol_type = other RNA
cacctagaaatgatgctat

SEQ ID NO: 861 - RNA, 19 nt, synthetic construct
  misc_feature 1..19: note = RNAi agent sense strand 19-mer core base sequence
  source 1..19: mol_type = other RNA
cacctagaaatgatgctaa

SEQ ID NO: 862 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cacctagaaatgatgctan

SEQ ID NO: 863 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacctagaaatgatgctan

SEQ ID NO: 864 - RNA, 19 nt, synthetic construct
  misc_feature 1..19: note = RNAi agent sense strand 19-mer core base sequence
  modified_base 16: mod_base = i
  source 1..19: mol_type = other RNA
agctctgtctcttctntct

SEQ ID NO: 865 - RNA, 19 nt, synthetic construct
  misc_feature 1..19: note = RNAi agent sense strand 19-mer core base sequence
  modified_base 16: mod_base = i
  source 1..19: mol_type = other RNA
agctctgtctcttctntca

SEQ ID NO: 866 - RNA, 19 nt, synthetic construct
  misc_feature 1..19: note = RNAi agent sense strand 19-mer core base sequence
  modified_base 16: mod_base = i
  misc_difference 19: note = a, c, u, g, unknown or other
  source 1..19: mol_type = other RNA
agctctgtctcttctntcn

SEQ ID NO: 867 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 16: mod_base = i
  source 1..19: mol_type = other RNA
ngctctgtctcttctntcn

SEQ ID NO: 868 - RNA, 19 nt, synthetic construct
  misc_feature 1..19: note = RNAi agent sense strand 19-mer core base sequence
  modified_base 1: mod_base = OTHER; note = 2-aminoadenine
  source 1..19: mol_type = other RNA
naggcttggttttcttact

SEQ ID NO: 869 - RNA, 19 nt, synthetic construct
  misc_feature 1..19: note = RNAi agent sense strand 19-mer core base sequence
  modified_base 1: mod_base = OTHER; note = 2-aminoadenine
  source 1..19: mol_type = other RNA
naggcttggttttcttaca

SEQ ID NO: 870 - RNA, 19 nt, synthetic construct
  misc_feature 1..19: note = RNAi agent sense strand 19-mer core base sequence
  modified_base 1: mod_base = OTHER; note = 2-aminoadenine
  misc_difference 19: note = a, c, u, g, unknown or other
  source 1..19: mol_type = other RNA
naggcttggttttcttacn

SEQ ID NO: 871 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naggcttggttttcttacn

SEQ ID NO: 872 - RNA, 19 nt, synthetic construct
  misc_feature 1..19: note = RNAi agent sense strand 19-mer core base sequence
  source 1..19: mol_type = other RNA
aaggcttggttttcttact

SEQ ID NO: 873 - RNA, 19 nt, synthetic construct
  misc_feature 1..19: note = RNAi agent sense strand 19-mer core base sequence
  source 1..19: mol_type = other RNA
aaggcttggttttcttaca

SEQ ID NO: 874 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
aaggcttggttttcttacn

SEQ ID NO: 875 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naggcttggttttcttacn

SEQ ID NO: 876 - RNA, 19 nt, synthetic construct
  misc_feature 1..19: note = RNAi agent sense strand 19-mer core base sequence
  source 1..19: mol_type = other RNA
gtgatgctctccaagtata

SEQ ID NO: 877 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gtgatgctctccaagtatn

SEQ ID NO: 878 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ntgatgctctccaagtatn

SEQ ID NO: 879 - RNA, 19 nt, synthetic construct
  modified_base 16: mod_base = i
  misc_feature 1..19: note = RNAi agent sense strand 19-mer core base sequence
  source 1..19: mol_type = other RNA
caagtatgatcgtctncaa

SEQ ID NO: 880 - RNA, 19 nt, synthetic construct
  misc_feature 1..19: note = RNAi agent sense strand 19-mer core base sequence
  modified_base 16: mod_base = i
  misc_difference 19: note = a, c, u, g, unknown or other
  source 1..19: mol_type = other RNA
caagtatgatcgtctncan

SEQ ID NO: 881 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 16: mod_base = i
  source 1..19: mol_type = other RNA
naagtatgatcgtctncan

SEQ ID NO: 882 - RNA, 19 nt, synthetic construct
  misc_feature 1..19: note = RNAi agent sense strand 19-mer core base sequence
  source 1..19: mol_type = other RNA
gcatgagagttttattcaa

SEQ ID NO: 883 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gcatgagagttttattcan

SEQ ID NO: 884 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ncatgagagttttattcan

SEQ ID NO: 885 - RNA, 19 nt, synthetic construct
  misc_feature 1..19: note = RNAi agent sense strand 19-mer core base sequence
  modified_base 14: mod_base = OTHER; note = 2-aminoadenine
  source 1..19: mol_type = other RNA
gcatgagagttttnttcaa

SEQ ID NO: 886 - RNA, 19 nt, synthetic construct
  misc_feature 1..19: note = RNAi agent sense strand 19-mer core base sequence
  modified_base 14: mod_base = OTHER; note = 2-aminoadenine
  misc_difference 19: note = a, c, u, g, unknown or other
  source 1..19: mol_type = other RNA
gcatgagagttttnttcan

SEQ ID NO: 887 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 14: mod_base = OTHER; note = 2-aminoadenine
  source 1..19: mol_type = other RNA
ncatgagagttttnttcan

SEQ ID NO: 888 - RNA, 19 nt, synthetic construct
  misc_feature 1..19: note = RNAi agent sense strand 19-mer core base sequence
  source 1..19: mol_type = other RNA
caagatcgtccacttttct

SEQ ID NO: 889 - RNA, 19 nt, synthetic construct
  misc_feature 1..19: note = RNAi agent sense strand 19-mer core base sequence
  source 1..19: mol_type = other RNA
caagatcgtccacttttct

SEQ ID NO: 890 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
caagatcgtccacttttcn

SEQ ID NO: 891 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naagatcgtccacttttcn

SEQ ID NO: 892 - RNA, 19 nt, synthetic construct
  misc_feature 1..19: note = RNAi agent sense strand 19-mer core base sequence
  source 1..19: mol_type = other RNA
catgttgcagtgacaacta

SEQ ID NO: 893 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
catgttgcagtgacaactn

SEQ ID NO: 894 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
natgttgcagtgacaactn

SEQ ID NO: 895 - RNA, 19 nt, synthetic construct
  misc_feature 1..19: note = RNAi agent sense strand 19-mer core base sequence
  source 1..19: mol_type = other RNA
tgacaactgtggaaggaat

SEQ ID NO: 896 - RNA, 19 nt, synthetic construct
  misc_feature 1..19: note = RNAi agent sense strand 19-mer core base sequence
  source 1..19: mol_type = other RNA
tgacaactgtggaaggaaa

SEQ ID NO: 897 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tgacaactgtggaaggaan

SEQ ID NO: 898 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngacaactgtggaaggaan

SEQ ID NO: 899 - RNA, 19 nt, synthetic construct
  misc_feature 1..19: note = RNAi agent sense strand 19-mer core base sequence
  source 1..19: mol_type = other RNA
ggaggagattgagaatgca

SEQ ID NO: 900 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggaggagattgagaatgcn

SEQ ID NO: 901 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngaggagattgagaatgcn

SEQ ID NO: 902 - RNA, 19 nt, synthetic construct
  misc_feature 1..19: note = RNAi agent sense strand 19-mer core base sequence
  source 1..19: mol_type = other RNA
cacggagattggcattgaa

SEQ ID NO: 903 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
cacggagattggcattgan

SEQ ID NO: 904 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nacggagattggcattgan

SEQ ID NO: 905 - RNA, 19 nt, synthetic construct
  misc_feature 1..19: note = RNAi agent sense strand 19-mer core base sequence
  modified_base 18: mod_base = OTHER; note = 2-aminoadenine
  source 1..19: mol_type = other RNA
agatgaagttcaagaatnt

SEQ ID NO: 906 - RNA, 19 nt, synthetic construct
  misc_feature 1..19: note = RNAi agent sense strand 19-mer core base sequence
  modified_base 18: mod_base = OTHER; note = 2-aminoadenine
  source 1..19: mol_type = other RNA
agatgaagttcaagaatna

SEQ ID NO: 907 - RNA, 19 nt, synthetic construct
  misc_feature 1..19: note = RNAi agent sense strand 19-mer core base sequence
  modified_base 18: mod_base = OTHER; note = 2-aminoadenine
  misc_difference 19: note = a, c, u, g, unknown or other
  source 1..19: mol_type = other RNA
agatgaagttcaagaatnn

SEQ ID NO: 908 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  modified_base 18: mod_base = OTHER; note = 2-aminoadenine
  source 1..19: mol_type = other RNA
ngatgaagttcaagaatnn

SEQ ID NO: 909 - RNA, 19 nt, synthetic construct
  misc_feature 1..19: note = RNAi agent sense strand 19-mer core base sequence
  source 1..19: mol_type = other RNA
agatgaagttcaagaatat

SEQ ID NO: 910 - RNA, 19 nt, synthetic construct
  misc_feature 1..19: note = RNAi agent sense strand 19-mer core base sequence
  source 1..19: mol_type = other RNA
agatgaagttcaagaataa

SEQ ID NO: 911 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agatgaagttcaagaatan

SEQ ID NO: 912 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngatgaagttcaagaatan

SEQ ID NO: 913 - RNA, 19 nt, synthetic construct
  misc_feature 1..19: note = RNAi agent sense strand 19-mer core base sequence
  source 1..19: mol_type = other RNA
gagatactgctctccataa

SEQ ID NO: 914 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gagatactgctctccatan

SEQ ID NO: 915 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagatactgctctccatan

SEQ ID NO: 916 - RNA, 19 nt, synthetic construct
  misc_feature 1..19: note = RNAi agent sense strand 19-mer core base sequence
  source 1..19: mol_type = other RNA
ggagtatttctcagcatta

SEQ ID NO: 917 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggagtatttctcagcattn

SEQ ID NO: 918 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngagtatttctcagcattn

SEQ ID NO: 919 - RNA, 19 nt, synthetic construct
  misc_feature 1..19: note = RNAi agent sense strand 19-mer core base sequence
  source 1..19: mol_type = other RNA
gagtatttctcagcattca

SEQ ID NO: 920 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gagtatttctcagcattcn

SEQ ID NO: 921 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nagtatttctcagcattcn

SEQ ID NO: 922 - RNA, 19 nt, synthetic construct
  misc_feature 1..19: note = RNAi agent sense strand 19-mer core base sequence
  source 1..19: mol_type = other RNA
ggagagaagatgacattga

SEQ ID NO: 923 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
ggagagaagatgacattgn

SEQ ID NO: 924 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngagagaagatgacattgn

SEQ ID NO: 925 - RNA, 19 nt, synthetic construct
  misc_feature 1..19: note = RNAi agent sense strand 19-mer core base sequence
  source 1..19: mol_type = other RNA
taacataactggaatttgt

SEQ ID NO: 926 - RNA, 19 nt, synthetic construct
  misc_feature 1..19: note = RNAi agent sense strand 19-mer core base sequence
  source 1..19: mol_type = other RNA
taacataactggaatttga

SEQ ID NO: 927 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
taacataactggaatttgn

SEQ ID NO: 928 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
naacataactggaatttgn

SEQ ID NO: 929 - RNA, 19 nt, synthetic construct
  misc_feature 1..19: note = RNAi agent sense strand 19-mer core base sequence
  source 1..19: mol_type = other RNA
agccattatcacaattgaa

SEQ ID NO: 930 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
agccattatcacaattgan

SEQ ID NO: 931 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
ngccattatcacaattgan

SEQ ID NO: 932 - RNA, 19 nt, synthetic construct
  misc_feature 1..19: note = RNAi agent sense strand 19-mer core base sequence
  source 1..19: mol_type = other RNA
gctttgttgcaaaaatgtt

SEQ ID NO: 933 - RNA, 19 nt, synthetic construct
  misc_feature 1..19: note = RNAi agent sense strand 19-mer core base sequence
  source 1..19: mol_type = other RNA
gctttgttgcaaaaatgta

SEQ ID NO: 934 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gctttgttgcaaaaatgtn

SEQ ID NO: 935 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nctttgttgcaaaaatgtn

SEQ ID NO: 936 - RNA, 19 nt, synthetic construct
  misc_feature 1..19: note = RNAi agent sense strand 19-mer core base sequence
  source 1..19: mol_type = other RNA
tttgttgcaaaaatgttga

SEQ ID NO: 937 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
tttgttgcaaaaatgttgn

SEQ ID NO: 938 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nttgttgcaaaaatgttgn

SEQ ID NO: 939 - RNA, 19 nt, synthetic construct
  misc_feature 1..19: note = RNAi agent sense strand 19-mer core base sequence
  source 1..19: mol_type = other RNA
gattgtggttcgagtgaaa

SEQ ID NO: 940 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gattgtggttcgagtgaan

SEQ ID NO: 941 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nattgtggttcgagtgaan

SEQ ID NO: 942 - RNA, 19 nt, synthetic construct
  misc_feature 1..19: note = RNAi agent sense strand 19-mer core base sequence
  source 1..19: mol_type = other RNA
gattgagaatgccttccaa

SEQ ID NO: 943 - RNA, 19 nt, synthetic construct
  misc_feature 1..19: note = RNAi agent sense strand 19-mer core base sequence
  misc_difference 19: note = a, c, u, g, unknown or other
  source 1..19: mol_type = other RNA
gattgagaatgccttccan

SEQ ID NO: 944 - RNA, 19 nt, synthetic construct
  misc_feature 1..19: note = RNAi agent sense strand 19-mer core base sequence
  misc_difference 1: note = a, c, u, g, unknown or other
  misc_difference 19: note = a, c, u, g, unknown or other
  source 1..19: mol_type = other RNA
nattgagaatgccttccan

SEQ ID NO: 945 - RNA, 21 nt, synthetic construct
  misc_feature 1..21: note = RNAi agent antisense strand modified sequence
  source 1..21: mol_type = other RNA
ttggaaggcattctcaatctc

SEQ ID NO: 946 - RNA, 21 nt, synthetic construct
  misc_feature 1..21: note = RNAi agent antisense strand modified sequence
  source 1..21: mol_type = other RNA
ttggaaggcattctcaatctc

SEQ ID NO: 947 - RNA, 21 nt, synthetic construct
  misc_feature 1..21: note = RNAi agent antisense strand modified sequence
  source 1..21: mol_type = other RNA
aacttgaagaagaagctgagg

SEQ ID NO: 948 - RNA, 21 nt, synthetic construct
  misc_feature 1..21: note = RNAi agent antisense strand modified sequence
  source 1..21: mol_type = other RNA
agaacttgaagaagaagctgc

SEQ ID NO: 949 - RNA, 21 nt, synthetic construct
  misc_feature 1..21: note = RNAi agent antisense strand modified sequence
  source 1..21: mol_type = other RNA
tgtagaacttgaagaagaagc

SEQ ID NO: 950 - RNA, 21 nt, synthetic construct
  misc_feature 1..21: note = RNAi agent antisense strand modified sequence
  source 1..21: mol_type = other RNA
tcataggtgattttcacccct

SEQ ID NO: 951 - RNA, 21 nt, synthetic construct
  misc_feature 1..21: note = RNAi agent antisense strand modified sequence
  source 1..21: mol_type = other RNA
tttcataggtgattttcaccc

SEQ ID NO: 952 - RNA, 21 nt, synthetic construct
  misc_feature 1..21: note = RNAi agent antisense strand modified sequence
  source 1..21: mol_type = other RNA
tcttcataggtgattttcacc

SEQ ID NO: 953 - RNA, 21 nt, synthetic construct
  misc_feature 1..21: note = RNAi agent antisense strand modified sequence
  source 1..21: mol_type = other RNA
ttcttcataggtgattttcac

SEQ ID NO: 954 - RNA, 21 nt, synthetic construct
  misc_feature 1..21: note = RNAi agent antisense strand modified sequence
  source 1..21: mol_type = other RNA
aattgtgataatggctggtag

SEQ ID NO: 955 - RNA, 21 nt, synthetic construct
  misc_feature 1..21: note = RNAi agent antisense strand modified sequence
  source 1..21: mol_type = other RNA
tcataaaaggagttgttcttc

SEQ ID NO: 956 - RNA, 21 nt, synthetic construct
  misc_feature 1..21: note = RNAi agent antisense strand modified sequence
  source 1..21: mol_type = other RNA
tccataaaaggagttgttctc

SEQ ID NO: 957 - RNA, 21 nt, synthetic construct
  misc_feature 1..21: note = RNAi agent antisense strand modified sequence
  source 1..21: mol_type = other RNA
tacagtgttagtgcttgtctc

SEQ ID NO: 958 - RNA, 21 nt, synthetic construct
  misc_feature 1..21: note = RNAi agent antisense strand modified sequence
  source 1..21: mol_type = other RNA
ttgtgtacatactcatgacga

SEQ ID NO: 959 - RNA, 21 nt, synthetic construct
  misc_feature 1..21: note = RNAi agent antisense strand modified sequence
  source 1..21: mol_type = other RNA
taccagttatcagcatgtcct

SEQ ID NO: 960 - RNA, 21 nt, synthetic construct
  misc_feature 1..21: note = RNAi agent antisense strand modified sequence
  source 1..21: mol_type = other RNA
tatgaagccaaccttgtatcc

SEQ ID NO: 961 - RNA, 21 nt, synthetic construct
  misc_feature 1..21: note = RNAi agent antisense strand modified sequence
  source 1..21: mol_type = other RNA
tcttcatgaagccaaccttgc

SEQ ID NO: 962 - RNA, 21 nt, synthetic construct
  misc_feature 1..21: note = RNAi agent antisense strand modified sequence
  source 1..21: mol_type = other RNA
ttcttcatgaagccaaccttg

SEQ ID NO: 963 - RNA, 21 nt, synthetic construct
  misc_feature 1..21: note = RNAi agent antisense strand modified sequence
  source 1..21: mol_type = other RNA
tagtcttcatgaagccaacct

SEQ ID NO: 964 - RNA, 21 nt, synthetic construct
  misc_feature 1..21: note = RNAi agent antisense strand modified sequence
  source 1..21: mol_type = other RNA
tctttttccaacaattctcct

SEQ ID NO: 965 - RNA, 21 nt, synthetic construct
  misc_feature 1..21: note = RNAi agent antisense strand modified sequence
  source 1..21: mol_type = other RNA
ttctacttcagagcaagccac

SEQ ID NO: 966 - RNA, 21 nt, synthetic construct
  misc_feature 1..21: note = RNAi agent antisense strand modified sequence
  source 1..21: mol_type = other RNA
tatttctacttcagagcaagc

SEQ ID NO: 967 - RNA, 21 nt, synthetic construct
  misc_feature 1..21: note = RNAi agent antisense strand modified sequence
  source 1..21: mol_type = other RNA
tgtccaatatcaatggcaggg

SEQ ID NO: 968 - RNA, 21 nt, synthetic construct
  misc_feature 1..21: note = RNAi agent antisense strand modified sequence
  source 1..21: mol_type = other RNA
tcagaaaagtggacgatcttg

SEQ ID NO: 969 - RNA, 21 nt, synthetic construct
  misc_feature 1..21: note = RNAi agent antisense strand modified sequence
  source 1..21: mol_type = other RNA
acaacattatctgcttcggac

SEQ ID NO: 970 - RNA, 21 nt, synthetic construct
  misc_feature 1..21: note = RNAi agent antisense strand modified sequence
  source 1..21: mol_type = other RNA
tcataatactctgagagagac

SEQ ID NO: 971 - RNA, 21 nt, synthetic construct
  misc_feature 1..21: note = RNAi agent antisense strand modified sequence
  source 1..21: mol_type = other RNA
tcttattccaaacttggtggg

SEQ ID NO: 972 - RNA, 21 nt, synthetic construct
  misc_feature 1..21: note = RNAi agent antisense strand modified sequence
  source 1..21: mol_type = other RNA
tagtaatcttgctttatgcag

SEQ ID NO: 973 - RNA, 21 nt, synthetic construct
  misc_feature 1..21: note = RNAi agent antisense strand modified sequence
  source 1..21: mol_type = other RNA
aaagaaatctagaacattgtc

SEQ ID NO: 974 - RNA, 21 nt, synthetic construct
  misc_feature 1..21: note = RNAi agent antisense strand modified sequence
  source 1..21: mol_type = other RNA
tcagaaaagtggacgatcttg

SEQ ID NO: 975 - RNA, 21 nt, synthetic construct
  misc_feature 1..21: note = RNAi agent antisense strand modified sequence
  source 1..21: mol_type = other RNA
acaacattatctgcttcggac

SEQ ID NO: 976 - RNA, 21 nt, synthetic construct
  misc_feature 1..21: note = RNAi agent antisense strand modified sequence
  source 1..21: mol_type = other RNA
tcataatactctgagagagac

SEQ ID NO: 977 - RNA, 21 nt, synthetic construct
  misc_feature 1..21: note = RNAi agent antisense strand modified sequence
  source 1..21: mol_type = other RNA
aaagaaatctagaacattttc

SEQ ID NO: 978 - RNA, 21 nt, synthetic construct
  misc_feature 1..21: note = RNAi agent antisense strand modified sequence
  source 1..21: mol_type = other RNA
tcagaaaagtggacgatcttg

SEQ ID NO: 979 - RNA, 21 nt, synthetic construct
  misc_feature 1..21: note = RNAi agent antisense strand modified sequence
  source 1..21: mol_type = other RNA
tcataatactctgagagagac

SEQ ID NO: 980 - RNA, 21 nt, synthetic construct
  misc_feature 1..21: note = RNAi agent antisense strand modified sequence
  source 1..21: mol_type = other RNA
tcttattccaaacttggtggg

SEQ ID NO: 981 - RNA, 21 nt, synthetic construct
  misc_feature 1..21: note = RNAi agent antisense strand modified sequence
  source 1..21: mol_type = other RNA
tagtaatcttgctttatgcag

SEQ ID NO: 982 - RNA, 21 nt, synthetic construct
  misc_feature 1..21: note = RNAi agent antisense strand modified sequence
  source 1..21: mol_type = other RNA
taacttcactcatccagcact

SEQ ID NO: 983 - RNA, 21 nt, synthetic construct
  misc_feature 1..21: note = RNAi agent antisense strand modified sequence
  source 1..21: mol_type = other RNA
tcaacttcactcatccagcac

SEQ ID NO: 984 - RNA, 21 nt, synthetic construct
  misc_feature 1..21: note = RNAi agent antisense strand modified sequence
  source 1..21: mol_type = other RNA
tgcaacttcactcatccagca

SEQ ID NO: 985 - RNA, 21 nt, synthetic construct
  misc_feature 1..21: note = RNAi agent antisense strand modified sequence
  source 1..21: mol_type = other RNA
tgatcatacttggagagcatc

SEQ ID NO: 986 - RNA, 21 nt, synthetic construct
  misc_feature 1..21: note = RNAi agent antisense strand modified sequence
  source 1..21: mol_type = other RNA
tcttgttctgcagacgatcac

SEQ ID NO: 987 - RNA, 21 nt, synthetic construct
  misc_feature 1..21: note = RNAi agent antisense strand modified sequence
  source 1..21: mol_type = other RNA
tgatcttgttctgcagacgac

SEQ ID NO: 988 - RNA, 21 nt, synthetic construct
  misc_feature 1..21: note = RNAi agent antisense strand modified sequence
  source 1..21: mol_type = other RNA
tagtaaagttgcactggcgac

SEQ ID NO: 989 - RNA, 21 nt, synthetic construct
  misc_feature 1..21: note = RNAi agent antisense strand modified sequence
  source 1..21: mol_type = other RNA
taacacaagtaaccttatcct

SEQ ID NO: 990 - RNA, 21 nt, synthetic construct
  misc_feature 1..21: note = RNAi agent antisense strand modified sequence
  source 1..21: mol_type = other RNA
tcaattgtgataatggctggt

SEQ ID NO: 991 - RNA, 21 nt, synthetic construct
  misc_feature 1..21: note = RNAi agent antisense strand modified sequence
  source 1..21: mol_type = other RNA
tagcatgatactgagagcttg

SEQ ID NO: 992 - RNA, 21 nt, synthetic construct
  misc_feature 1..21: note = RNAi agent antisense strand modified sequence
  source 1..21: mol_type = other RNA
aacttgtcaacctcactcttc

SEQ ID NO: 993 - RNA, 21 nt, synthetic construct
  misc_feature 1..21: note = RNAi agent antisense strand modified sequence
  source 1..21: mol_type = other RNA
taacttgtcaacctcactctc

SEQ ID NO: 994 - RNA, 21 nt, synthetic construct
  misc_feature 1..21: note = RNAi agent antisense strand modified sequence
  source 1..21: mol_type = other RNA
taacaattctccttgttgaac

SEQ ID NO: 995 - RNA, 21 nt, synthetic construct
  misc_feature 1..21: note = RNAi agent antisense strand modified sequence
  source 1..21: mol_type = other RNA
tcatgttctgtggtatgttcc

SEQ ID NO: 996 - RNA, 21 nt, synthetic construct
  misc_feature 1..21: note = RNAi agent antisense strand modified sequence
  source 1..21: mol_type = other RNA
tactttaatagatccatgttc

SEQ ID NO: 997 - RNA, 21 nt, synthetic construct
  misc_feature 1..21: note = RNAi agent antisense strand modified sequence
  source 1..21: mol_type = other RNA
tgactttaatagatccatgtc

SEQ ID NO: 998 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 999 - RNA, 21 nt, synthetic construct
  misc_feature 1..21: note = RNAi agent antisense strand modified sequence
  source 1..21: mol_type = other RNA
tgtttaagcttctagaggttc

SEQ ID NO: 1000 - RNA, 21 nt, synthetic construct
  misc_feature 1..21: note = RNAi agent antisense strand modified sequence
  source 1..21: mol_type = other RNA
ttgttcattggtttgaaggcc

SEQ ID NO: 1001 - RNA, 21 nt, synthetic construct
  misc_feature 1..21: note = RNAi agent antisense strand modified sequence
  source 1..21: mol_type = other RNA
ttatgctttgctgttcattgg

SEQ ID NO: 1002 - RNA, 21 nt, synthetic construct
  misc_feature 1..21: note = RNAi agent antisense strand modified sequence
  source 1..21: mol_type = other RNA
tgttatgctttgctgttcatc

SEQ ID NO: 1003 - RNA, 21 nt, synthetic construct
  misc_feature 1..21: note = RNAi agent antisense strand modified sequence
  source 1..21: mol_type = other RNA
aggttatgctttgctgttcac

SEQ ID NO: 1004 - RNA, 21 nt, synthetic construct
  misc_feature 1..21: note = RNAi agent antisense strand modified sequence
  source 1..21: mol_type = other RNA
taaggttatgctttgctgttc

SEQ ID NO: 1005 - RNA, 21 nt, synthetic construct
  misc_feature 1..21: note = RNAi agent antisense strand modified sequence
  source 1..21: mol_type = other RNA
agattcaaggttatgctttgc

SEQ ID NO: 1006 - RNA, 21 nt, synthetic construct
  misc_feature 1..21: note = RNAi agent antisense strand modified sequence
  source 1..21: mol_type = other RNA
ttcaataattgagttggttgg

SEQ ID NO: 1007 - RNA, 21 nt, synthetic construct
  misc_feature 1..21: note = RNAi agent antisense strand modified sequence
  source 1..21: mol_type = other RNA
agtaaaatggatcacaggaag

SEQ ID NO: 1008 - RNA, 21 nt, synthetic construct
  misc_feature 1..21: note = RNAi agent antisense strand modified sequence
  source 1..21: mol_type = other RNA
tcatatgacagtaagaaaacc

SEQ ID NO: 1009 - RNA, 21 nt, synthetic construct
  misc_feature 1..21: note = RNAi agent antisense strand modified sequence
  source 1..21: mol_type = other RNA
ttggaaggcattctcgatctc

SEQ ID NO: 1010 - RNA, 21 nt, synthetic construct
  misc_feature 1..21: note = RNAi agent antisense strand modified sequence
  source 1..21: mol_type = other RNA
tcatcattgaaaatgccagtc

SEQ ID NO: 1011 - RNA, 21 nt, synthetic construct
  misc_feature 1..21: note = RNAi agent antisense strand modified sequence
  source 1..21: mol_type = other RNA
aaagacagtttcatcattgac

SEQ ID NO: 1012 - RNA, 21 nt, synthetic construct
  misc_feature 1..21: note = RNAi agent antisense strand modified sequence
  source 1..21: mol_type = other RNA
aacacaagtaacctcatcctc

SEQ ID NO: 1013 - RNA, 21 nt, synthetic construct
  misc_feature 1..21: note = RNAi agent antisense strand modified sequence
  source 1..21: mol_type = other RNA
agacaacattgtcagcttcag

SEQ ID NO: 1014 - RNA, 21 nt, synthetic construct
  misc_feature 1..21: note = RNAi agent antisense strand modified sequence
  source 1..21: mol_type = other RNA
tcaacatctttgcaataaagc

SEQ ID NO: 1015 - RNA, 21 nt, synthetic construct
  misc_feature 1..21: note = RNAi agent antisense strand modified sequence
  source 1..21: mol_type = other RNA
agattagtcttacaaatcctc

SEQ ID NO: 1016 - RNA, 21 nt, synthetic construct
  misc_feature 1..21: note = RNAi agent antisense strand modified sequence
  source 1..21: mol_type = other RNA
tcttattccaaacttagtcgg

SEQ ID NO: 1017 - RNA, 21 nt, synthetic construct
  misc_feature 1..21: note = RNAi agent antisense strand modified sequence
  source 1..21: mol_type = other RNA
tcagaaaagaaagtgtgaagc

SEQ ID NO: 1018 - RNA, 21 nt, synthetic construct
  misc_feature 1..21: note = RNAi agent antisense strand modified sequence
  source 1..21: mol_type = other RNA
tagagtttgtctcaaagctgc

SEQ ID NO: 1019 - RNA, 21 nt, synthetic construct
  misc_feature 1..21: note = RNAi agent antisense strand modified sequence
  source 1..21: mol_type = other RNA
ttgttaagcagtcaatttctc

SEQ ID NO: 1020 - RNA, 21 nt, synthetic construct
  misc_feature 1..21: note = RNAi agent antisense strand modified sequence
  source 1..21: mol_type = other RNA
ttggaaatctggatactacgg

SEQ ID NO: 1021 - RNA, 21 nt, synthetic construct
  misc_feature 1..21: note = RNAi agent antisense strand modified sequence
  source 1..21: mol_type = other RNA
tcttgaaaatgccatcctgct

SEQ ID NO: 1022 - RNA, 21 nt, synthetic construct
  misc_feature 1..21: note = RNAi agent antisense strand modified sequence
  source 1..21: mol_type = other RNA
atgatttggatcacaattgtc

SEQ ID NO: 1023 - RNA, 21 nt, synthetic construct
  misc_feature 1..21: note = RNAi agent antisense strand modified sequence
  source 1..21: mol_type = other RNA
tagaattactcaaaactgcca

SEQ ID NO: 1024 - RNA, 21 nt, synthetic construct
  misc_feature 1..21: note = RNAi agent antisense strand modified sequence
  source 1..21: mol_type = other RNA
tgatcaaaaatggactcagac

SEQ ID NO: 1025 - RNA, 21 nt, synthetic construct
  misc_feature 1..21: note = RNAi agent antisense strand modified sequence
  source 1..21: mol_type = other RNA
taagaaagcatgcagatctag

SEQ ID NO: 1026 - RNA, 21 nt, synthetic construct
  misc_feature 1..21: note = RNAi agent antisense strand modified sequence
  source 1..21: mol_type = other RNA
tcagatataagctctctgaag

SEQ ID NO: 1027 - RNA, 21 nt, synthetic construct
  misc_feature 1..21: note = RNAi agent antisense strand modified sequence
  source 1..21: mol_type = other RNA
tatgaagccaaccttgtatcc

SEQ ID NO: 1028 - RNA, 21 nt, synthetic construct
  misc_feature 1..21: note = RNAi agent antisense strand modified sequence
  source 1..21: mol_type = other RNA
tatgaagccaaccttgtatcc

SEQ ID NO: 1029 - RNA, 21 nt, synthetic construct
  misc_feature 1..21: note = RNAi agent antisense strand modified sequence
  source 1..21: mol_type = other RNA
tatgaagccaaccttgtatcc

SEQ ID NO: 1030 - RNA, 21 nt, synthetic construct
  misc_feature 1..21: note = RNAi agent antisense strand modified sequence
  source 1..21: mol_type = other RNA
tatgaagtcaaccttgtatcc

SEQ ID NO: 1031 - RNA, 21 nt, synthetic construct
  misc_feature 1..21: note = RNAi agent antisense strand modified sequence
  source 1..21: mol_type = other RNA
tatgaagctaaccttgtatcc

SEQ ID NO: 1032 - RNA, 21 nt, synthetic construct
  misc_feature 1..21: note = RNAi agent antisense strand modified sequence
  source 1..21: mol_type = other RNA
tatgaagccaaccttgtatcc

SEQ ID NO: 1033 - RNA, 21 nt, synthetic construct
  misc_feature 1..21: note = RNAi agent antisense strand modified sequence
  source 1..21: mol_type = other RNA
tcttcatgaagccaaccttgc

SEQ ID NO: 1034 - RNA, 21 nt, synthetic construct
  misc_feature 1..21: note = RNAi agent antisense strand modified sequence
  source 1..21: mol_type = other RNA
tcttcatgaagccaaccttgc

SEQ ID NO: 1035 - RNA, 21 nt, synthetic construct
  misc_feature 1..21: note = RNAi agent antisense strand modified sequence
  source 1..21: mol_type = other RNA
tcttcatgaagccaaccttgc

SEQ ID NO: 1036 - RNA, 21 nt, synthetic construct
  misc_feature 1..21: note = RNAi agent antisense strand modified sequence
  source 1..21: mol_type = other RNA
tggatctgcatttttctccac

SEQ ID NO: 1037 - RNA, 21 nt, synthetic construct
  misc_feature 1..21: note = RNAi agent antisense strand modified sequence
  source 1..21: mol_type = other RNA
tccaaaagggttgtctctgga

SEQ ID NO: 1038 - RNA, 21 nt, synthetic construct
  misc_feature 1..21: note = RNAi agent antisense strand modified sequence
  source 1..21: mol_type = other RNA
tagacgatcatacttggagag

SEQ ID NO: 1039 - RNA, 21 nt, synthetic construct
  misc_feature 1..21: note = RNAi agent antisense strand modified sequence
  source 1..21: mol_type = other RNA
tcctattccttccacagttgc

SEQ ID NO: 1040 - RNA, 21 nt, synthetic construct
  misc_feature 1..21: note = RNAi agent antisense strand modified sequence
  source 1..21: mol_type = other RNA
tacatactcatgacgatgcca

SEQ ID NO: 1041 - RNA, 21 nt, synthetic construct
  misc_feature 1..21: note = RNAi agent antisense strand modified sequence
  source 1..21: mol_type = other RNA
tcacagatttccttggaaggc

SEQ ID NO: 1042 - RNA, 21 nt, synthetic construct
  misc_feature 1..21: note = RNAi agent antisense strand modified sequence
  source 1..21: mol_type = other RNA
tgaacttcatctcaatgccac

SEQ ID NO: 1043 - RNA, 21 nt, synthetic construct
  misc_feature 1..21: note = RNAi agent antisense strand modified sequence
  source 1..21: mol_type = other RNA
agcatattcttgaacttcatc

SEQ ID NO: 1044 - RNA, 21 nt, synthetic construct
  misc_feature 1..21: note = RNAi agent antisense strand modified sequence
  source 1..21: mol_type = other RNA
tcataggaaacagcatattcc

SEQ ID NO: 1045 - RNA, 21 nt, synthetic construct
  misc_feature 1..21: note = RNAi agent antisense strand modified sequence
  source 1..21: mol_type = other RNA
tggatctctatggagagcagc

SEQ ID NO: 1046 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1047 - RNA, 21 nt, synthetic construct
  misc_feature 1..21: note = RNAi agent antisense strand modified sequence
  source 1..21: mol_type = other RNA
tctatggacttgatcttggcg

SEQ ID NO: 1048 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1049 - RNA, 21 nt, synthetic construct
  misc_feature 1..21: note = RNAi agent antisense strand modified sequence
  source 1..21: mol_type = other RNA
tggtagttcttcataggtgac

SEQ ID NO: 1050 - RNA, 21 nt, synthetic construct
  misc_feature 1..21: note = RNAi agent antisense strand modified sequence
  source 1..21: mol_type = other RNA
tgataatggctggtagttctc

SEQ ID NO: 1051 - RNA, 21 nt, synthetic construct
  misc_feature 1..21: note = RNAi agent antisense strand modified sequence
  source 1..21: mol_type = other RNA
tctcaattgtgataatggctg

SEQ ID NO: 1052 - RNA, 21 nt, synthetic construct
  misc_feature 1..21: note = RNAi agent antisense strand modified sequence
  source 1..21: mol_type = other RNA
tctttctcgatcttcagctca

SEQ ID NO: 1053 - RNA, 21 nt, synthetic construct
  misc_feature 1..21: note = RNAi agent antisense strand modified sequence
  source 1..21: mol_type = other RNA
tttggaacagcaatggtgcag

SEQ ID NO: 1054 - RNA, 21 nt, synthetic construct
  misc_feature 1..21: note = RNAi agent antisense strand modified sequence
  source 1..21: mol_type = other RNA
tgtagacacaaagagctccac

SEQ ID NO: 1055 - RNA, 21 nt, synthetic construct
  misc_feature 1..21: note = RNAi agent antisense strand modified sequence
  source 1..21: mol_type = other RNA
tctgtgtagacacaaagagct

SEQ ID NO: 1056 - RNA, 21 nt, synthetic construct
  misc_feature 1..21: note = RNAi agent antisense strand modified sequence
  source 1..21: mol_type = other RNA
ttccataatactctgagagag

SEQ ID NO: 1057 - RNA, 21 nt, synthetic construct
  misc_feature 1..21: note = RNAi agent antisense strand modified sequence
  source 1..21: mol_type = other RNA
tctcgttccataatactctgc

SEQ ID NO: 1058 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1059 - RNA, 21 nt, synthetic construct
  misc_feature 1..21: note = RNAi agent antisense strand modified sequence
  source 1..21: mol_type = other RNA
ttccataatactctgagagag

SEQ ID NO: 1060 - RNA, 21 nt, synthetic construct
  misc_feature 1..21: note = RNAi agent antisense strand modified sequence
  source 1..21: mol_type = other RNA
aatgaaacaaacaaaccctgg

SEQ ID NO: 1061 - RNA, 21 nt, synthetic construct
  misc_feature 1..21: note = RNAi agent antisense strand modified sequence
  source 1..21: mol_type = other RNA
aaatgaaacaaacaaaccctg

SEQ ID NO: 1062 - RNA, 21 nt, synthetic construct
  misc_feature 1..21: note = RNAi agent antisense strand modified sequence
  source 1..21: mol_type = other RNA
tgaaatgaaacaaacaaaccc

SEQ ID NO: 1063 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1064 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1065 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1066 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1067 - RNA, 21 nt, synthetic construct
  misc_feature 1..21: note = RNAi agent antisense strand modified sequence
  source 1..21: mol_type = other RNA
agacgatcatacttggagagc

SEQ ID NO: 1068 - RNA, 21 nt, synthetic construct
  misc_feature 1..21: note = RNAi agent antisense strand modified sequence
  source 1..21: mol_type = other RNA
aaggcattctcaatctcctcc

SEQ ID NO: 1069 - RNA, 21 nt, synthetic construct
  misc_feature 1..21: note = RNAi agent antisense strand modified sequence
  source 1..21: mol_type = other RNA
tttccttggaaggcattctcg

SEQ ID NO: 1070 - RNA, 21 nt, synthetic construct
  misc_feature 1..21: note = RNAi agent antisense strand modified sequence
  source 1..21: mol_type = other RNA
tagatttccttggaaggcatc

SEQ ID NO: 1071 - RNA, 21 nt, synthetic construct
  misc_feature 1..21: note = RNAi agent antisense strand modified sequence
  source 1..21: mol_type = other RNA
ataggaaacagcatattcttg

SEQ ID NO: 1072 - RNA, 21 nt, synthetic construct
  misc_feature 1..21: note = RNAi agent antisense strand modified sequence
  source 1..21: mol_type = other RNA
ttgatgatgttccctccaacg

SEQ ID NO: 1073 - RNA, 21 nt, synthetic construct
  misc_feature 1..21: note = RNAi agent antisense strand modified sequence
  source 1..21: mol_type = other RNA
tagaacttgaagaagaagctg

SEQ ID NO: 1074 - RNA, 21 nt, synthetic construct
  misc_feature 1..21: note = RNAi agent antisense strand modified sequence
  source 1..21: mol_type = other RNA
taccaatgatatgcccaacac

SEQ ID NO: 1075 - RNA, 21 nt, synthetic construct
  misc_feature 1..21: note = RNAi agent antisense strand modified sequence
  source 1..21: mol_type = other RNA
tcatggtgttctgtgtagacg

SEQ ID NO: 1076 - RNA, 21 nt, synthetic construct
  misc_feature 1..21: note = RNAi agent antisense strand modified sequence
  source 1..21: mol_type = other RNA
ttgagagagatcctgggtgtc

SEQ ID NO: 1077 - RNA, 21 nt, synthetic construct
  misc_feature 1..21: note = RNAi agent antisense strand modified sequence
  source 1..21: mol_type = other RNA
tcatgatactgagagcttgct

SEQ ID NO: 1078 - RNA, 21 nt, synthetic construct
  misc_feature 1..21: note = RNAi agent antisense strand modified sequence
  source 1..21: mol_type = other RNA
ttgtcaacctcactcttccga

SEQ ID NO: 1079 - RNA, 21 nt, synthetic construct
  misc_feature 1..21: note = RNAi agent antisense strand modified sequence
  source 1..21: mol_type = other RNA
tttccaacaattctccttgtc

SEQ ID NO: 1080 - RNA, 21 nt, synthetic construct
  misc_feature 1..21: note = RNAi agent antisense strand modified sequence
  source 1..21: mol_type = other RNA
ttgagttagtctcaaagctgc

SEQ ID NO: 1081 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1082 - RNA, 21 nt, synthetic construct
  misc_feature 1..21: note = RNAi agent antisense strand modified sequence
  source 1..21: mol_type = other RNA
tcatgacaatatctgtgcgga

SEQ ID NO: 1083 - RNA, 21 nt, synthetic construct
  misc_feature 1..21: note = RNAi agent antisense strand modified sequence
  source 1..21: mol_type = other RNA
tcaaagaagatagaagcagcc

SEQ ID NO: 1084 - RNA, 21 nt, synthetic construct
  misc_feature 1..21: note = RNAi agent antisense strand modified sequence
  source 1..21: mol_type = other RNA
tcacgttattacctgtgtgct

SEQ ID NO: 1085 - RNA, 21 nt, synthetic construct
  misc_feature 1..21: note = RNAi agent antisense strand modified sequence
  source 1..21: mol_type = other RNA
tagaacttgaggttatacagg

SEQ ID NO: 1086 - RNA, 21 nt, synthetic construct
  misc_feature 1..21: note = RNAi agent antisense strand modified sequence
  source 1..21: mol_type = other RNA
atgctttgctgttcattggtc

SEQ ID NO: 1087 - RNA, 21 nt, synthetic construct
  misc_feature 1..21: note = RNAi agent antisense strand modified sequence
  source 1..21: mol_type = other RNA
tagtatagattcaaggttatg

SEQ ID NO: 1088 - RNA, 21 nt, synthetic construct
  misc_feature 1..21: note = RNAi agent antisense strand modified sequence
  source 1..21: mol_type = other RNA
agagtaatcttgctttatgcc

SEQ ID NO: 1089 - RNA, 21 nt, synthetic construct
  misc_feature 1..21: note = RNAi agent antisense strand modified sequence
  source 1..21: mol_type = other RNA
atagcatcatttctaggtgga

SEQ ID NO: 1090 - RNA, 21 nt, synthetic construct
  misc_feature 1..21: note = RNAi agent antisense strand modified sequence
  source 1..21: mol_type = other RNA
agacagaagagacagagctag

SEQ ID NO: 1091 - RNA, 21 nt, synthetic construct
  misc_feature 1..21: note = RNAi agent antisense strand modified sequence
  source 1..21: mol_type = other RNA
agtaagaaaaccaagccttag

SEQ ID NO: 1092 - RNA, 21 nt, synthetic construct
  misc_feature 1..21: note = RNAi agent antisense strand modified sequence
  source 1..21: mol_type = other RNA
ttccataatactctgagagag

SEQ ID NO: 1093 - RNA, 21 nt, synthetic construct
  misc_feature 1..21: note = RNAi agent antisense strand modified sequence
  source 1..21: mol_type = other RNA
ttccataatactctgagagag

SEQ ID NO: 1094 - RNA, 21 nt, synthetic construct
  misc_feature 1..21: note = RNAi agent antisense strand modified sequence
  source 1..21: mol_type = other RNA
ttccataatactctgagagag

SEQ ID NO: 1095 - RNA, 21 nt, synthetic construct
  misc_feature 1..21: note = RNAi agent antisense strand modified sequence
  source 1..21: mol_type = other RNA
ttccataatactctgagagag

SEQ ID NO: 1096 - RNA, 21 nt, synthetic construct
  misc_feature 1..21: note = RNAi agent antisense strand modified sequence
  source 1..21: mol_type = other RNA
ttccataatactctgagagag

SEQ ID NO: 1097 - RNA, 21 nt, synthetic construct
  misc_feature 1..21: note = RNAi agent antisense strand modified sequence
  source 1..21: mol_type = other RNA
tatacttggagagcatcactg

SEQ ID NO: 1098 - RNA, 21 nt, synthetic construct
  misc_feature 1..21: note = RNAi agent antisense strand modified sequence
  source 1..21: mol_type = other RNA
ttgcagacgatcatacttggc

SEQ ID NO: 1099 - RNA, 21 nt, synthetic construct
  misc_feature 1..21: note = RNAi agent antisense strand modified sequence
  source 1..21: mol_type = other RNA
ttgaataaaactctcatgcca

SEQ ID NO: 1100 - RNA, 21 nt, synthetic construct
  misc_feature 1..21: note = RNAi agent antisense strand modified sequence
  source 1..21: mol_type = other RNA
ttgaataaaactctcatgcca

SEQ ID NO: 1101 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1102 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1103 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1104 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1105 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1106 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1107 - RNA, 21 nt, synthetic construct
  misc_feature 1..21: note = RNAi agent antisense strand modified sequence
  source 1..21: mol_type = other RNA
tacttgaagaagaagctgagg

SEQ ID NO: 1108 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1109 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1110 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1111 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1112 - RNA, 21 nt, synthetic construct
  misc_feature 1..21: note = RNAi agent antisense strand modified sequence
  source 1..21: mol_type = other RNA
tttgaatgctgagaaatactc

SEQ ID NO: 1113 - RNA, 21 nt, synthetic construct
  misc_feature 1..21: note = RNAi agent antisense strand modified sequence
  source 1..21: mol_type = other RNA
agaaaagtggacgatcttgtc

SEQ ID NO: 1114 - RNA, 21 nt, synthetic construct
  misc_feature 1..21: note = RNAi agent antisense strand modified sequence
  source 1..21: mol_type = other RNA
tagttgtcactgcaacatggt

SEQ ID NO: 1115 - RNA, 21 nt, synthetic construct
  misc_feature 1..21: note = RNAi agent antisense strand modified sequence
  source 1..21: mol_type = other RNA
attccttccacagttgtcacc

SEQ ID NO: 1116 - RNA, 21 nt, synthetic construct
  misc_feature 1..21: note = RNAi agent antisense strand modified sequence
  source 1..21: mol_type = other RNA
tgcattctcaatctcctccac

SEQ ID NO: 1117 - RNA, 21 nt, synthetic construct
  misc_feature 1..21: note = RNAi agent antisense strand modified sequence
  source 1..21: mol_type = other RNA
ttcaatgccaatctccgtgtc

SEQ ID NO: 1118 - RNA, 21 nt, synthetic construct
  misc_feature 1..21: note = RNAi agent antisense strand modified sequence
  source 1..21: mol_type = other RNA
atattcttgaacttcatctcg

SEQ ID NO: 1119 - RNA, 21 nt, synthetic construct
  misc_feature 1..21: note = RNAi agent antisense strand modified sequence
  source 1..21: mol_type = other RNA
ttatggagagcagtatctcct

SEQ ID NO: 1120 - RNA, 21 nt, synthetic construct
  misc_feature 1..21: note = RNAi agent antisense strand modified sequence
  source 1..21: mol_type = other RNA
taatgctgagaaatactcccc

SEQ ID NO: 1121 - RNA, 21 nt, synthetic construct
  misc_feature 1..21: note = RNAi agent antisense strand modified sequence
  source 1..21: mol_type = other RNA
tgaatgctgagaaatactccc

SEQ ID NO: 1122 - RNA, 21 nt, synthetic construct
  misc_feature 1..21: note = RNAi agent antisense strand modified sequence
  source 1..21: mol_type = other RNA
tcaatgtcatcttctctccgg

SEQ ID NO: 1123 - RNA, 21 nt, synthetic construct
  misc_feature 1..21: note = RNAi agent antisense strand modified sequence
  source 1..21: mol_type = other RNA
acaaattccagttatgttacc

SEQ ID NO: 1124 - RNA, 21 nt, synthetic construct
  misc_feature 1..21: note = RNAi agent antisense strand modified sequence
  source 1..21: mol_type = other RNA
ttcaattgtgataatggctgg

SEQ ID NO: 1125 - RNA, 21 nt, synthetic construct
  misc_feature 1..21: note = RNAi agent antisense strand modified sequence
  source 1..21: mol_type = other RNA
aacatttttgcaacaaagctc

SEQ ID NO: 1126 - RNA, 21 nt, synthetic construct
  misc_feature 1..21: note = RNAi agent antisense strand modified sequence
  source 1..21: mol_type = other RNA
tcaacatttttgcaacaaagc

SEQ ID NO: 1127 - RNA, 21 nt, synthetic construct
  misc_feature 1..21: note = RNAi agent antisense strand modified sequence
  source 1..21: mol_type = other RNA
tttcactcgaaccacaatccg

SEQ ID NO: 1128 - RNA, 21 nt, synthetic construct
  misc_feature 1..21: note = RNAi agent antisense strand modified sequence
  source 1..21: mol_type = other RNA
tcttattccaaacttggtggg

SEQ ID NO: 1129 - RNA, 21 nt, synthetic construct
  misc_feature 1..21: note = RNAi agent antisense strand modified sequence
  source 1..21: mol_type = other RNA
tcttattccaaacttggtggg

SEQ ID NO: 1130 - RNA, 21 nt, synthetic construct
  misc_feature 1..21: note = RNAi agent antisense strand modified sequence
  source 1..21: mol_type = other RNA
tcttattccaaacttggtggg

SEQ ID NO: 1131 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1132 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1133 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1134 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1135 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1136 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1137 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1138 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1139 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1140 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1141 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1142 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1143 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1144 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1145 - RNA, 21 nt, synthetic construct
  misc_feature 1..21: note = RNAi agent antisense strand modified sequence
  source 1..21: mol_type = other RNA
ttccataatactctgagagag

SEQ ID NO: 1146 - RNA, 21 nt, synthetic construct
  misc_feature 1..21: note = RNAi agent antisense strand modified sequence
  source 1..21: mol_type = other RNA
ttccataatactctgagagag

SEQ ID NO: 1147 - RNA, 21 nt, synthetic construct
  misc_feature 1..21: note = RNAi agent antisense strand modified sequence
  source 1..21: mol_type = other RNA
ttccataatactctgagagac

SEQ ID NO: 1148 - RNA, 21 nt, synthetic construct
  misc_feature 1..21: note = RNAi agent antisense strand modified sequence
  source 1..21: mol_type = other RNA
ttccataatactctgagaggg

SEQ ID NO: 1149 - RNA, 21 nt, synthetic construct
  misc_feature 1..21: note = RNAi agent antisense strand modified sequence
  source 1..21: mol_type = other RNA
ttccataatactctgagaggc

SEQ ID NO: 1150 - RNA, 21 nt, synthetic construct
  misc_feature 1..21: note = RNAi agent antisense strand modified sequence
  source 1..21: mol_type = other RNA
ttccataatactctgagaggt

SEQ ID NO: 1151 - RNA, 21 nt, synthetic construct
  misc_feature 1..21: note = RNAi agent antisense strand modified sequence
  source 1..21: mol_type = other RNA
ttccataatactctgagagga

SEQ ID NO: 1152 - RNA, 21 nt, synthetic construct
  misc_feature 1..21: note = RNAi agent antisense strand modified sequence
  source 1..21: mol_type = other RNA
ttccataatactctgagagag

SEQ ID NO: 1153 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1154 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1155 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1156 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1157 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1158 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1159 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1160 - RNA, 21 nt, synthetic construct
  misc_feature 1..21: note = RNAi agent antisense strand modified sequence
  source 1..21: mol_type = other RNA
tgcatattcaccatttaggca

SEQ ID NO: 1161 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1162 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1163 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1164 - RNA, 21 nt, synthetic construct
  misc_feature 1..21: note = RNAi agent antisense strand modified sequence
  source 1..21: mol_type = other RNA
ttgacaatatctgtgcggagg

SEQ ID NO: 1165 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1166 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1167 - RNA, 21 nt, synthetic construct
  misc_feature 1..21: note = RNAi agent antisense strand modified sequence
  source 1..21: mol_type = other RNA
atgacaatatctgtgcggagg

SEQ ID NO: 1168 - RNA, 20 nt, synthetic construct
  misc_feature 1..20: note = RNAi agent antisense strand modified sequence
  source 1..20: mol_type = other RNA
atgacaatatctgtgcggag

SEQ ID NO: 1169 - RNA, 19 nt, synthetic construct
  misc_feature 1..19: note = RNAi agent antisense strand modified sequence
  source 1..19: mol_type = other RNA
atgacaatatctgtgcgga

SEQ ID NO: 1170 - RNA, 21 nt, synthetic construct
  misc_feature 1..21: note = RNAi agent antisense strand modified sequence
  source 1..21: mol_type = other RNA
ttccataatactctgagagag

SEQ ID NO: 1171 - RNA, 21 nt, synthetic construct
  misc_feature 1..21: note = RNAi agent antisense strand modified sequence
  source 1..21: mol_type = other RNA
ttccataatactctgagagac

SEQ ID NO: 1172 - RNA, 21 nt, synthetic construct
  misc_feature 1..21: note = RNAi agent antisense strand modified sequence
  source 1..21: mol_type = other RNA
ttgaaacaaacaaaccctgga

SEQ ID NO: 1173 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1174 - RNA, 21 nt, synthetic construct
  misc_feature 1..21: note = RNAi agent antisense strand modified sequence
  source 1..21: mol_type = other RNA
atgaaacaaacaaaccctgga

SEQ ID NO: 1175 - RNA, 21 nt, synthetic construct
  misc_feature 1..21: note = RNAi agent sense strand modified sequence
  source 1..21: mol_type = other RNA
gagattgagaatgccttccaa

SEQ ID NO: 1176 - RNA, 21 nt, synthetic construct
  misc_feature 1..21: note = RNAi agent sense strand modified sequence
  source 1..21: mol_type = other RNA
gagattgagaatgccttccaa

SEQ ID NO: 1177 - RNA, 21 nt, synthetic construct
  misc_feature 1..21: note = RNAi agent sense strand modified sequence
  source 1..21: mol_type = other RNA
cctcagcttcttcttcaagtt

SEQ ID NO: 1178 - RNA, 21 nt, synthetic construct
  misc_feature 1..21: note = RNAi agent sense strand modified sequence
  source 1..21: mol_type = other RNA
gcagcttcttcttcaagttct

SEQ ID NO: 1179 - RNA, 21 nt, synthetic construct
  misc_feature 1..21: note = RNAi agent sense strand modified sequence
  source 1..21: mol_type = other RNA
gcttcttcttcaagttctaca

SEQ ID NO: 1180 - RNA, 21 nt, synthetic construct
  misc_feature 1..21: note = RNAi agent sense strand modified sequence
  source 1..21: mol_type = other RNA
aggggtgaaaatcacctatga

SEQ ID NO: 1181 - RNA, 21 nt, synthetic construct
  misc_feature 1..21: note = RNAi agent sense strand modified sequence
  source 1..21: mol_type = other RNA
gggtgaaaatcacctatgaaa

SEQ ID NO: 1182 - RNA, 21 nt, synthetic construct
  misc_feature 1..21: note = RNAi agent sense strand modified sequence
  source 1..21: mol_type = other RNA
ggtgaaaatcacctatgaaga

SEQ ID NO: 1183 - RNA, 21 nt, synthetic construct
  misc_feature 1..21: note = RNAi agent sense strand modified sequence
  source 1..21: mol_type = other RNA
gtgaaaatcacctatgaagaa

SEQ ID NO: 1184 - RNA, 21 nt, synthetic construct
  misc_feature 1..21: note = RNAi agent sense strand modified sequence
  source 1..21: mol_type = other RNA
ctaccagccattatcacaatt

SEQ ID NO: 1185 - RNA, 21 nt, synthetic construct
  misc_feature 1..21: note = RNAi agent sense strand modified sequence
  source 1..21: mol_type = other RNA
gaagaacaactccttttatga

SEQ ID NO: 1186 - RNA, 21 nt, synthetic construct
  misc_feature 1..21: note = RNAi agent sense strand modified sequence
  source 1..21: mol_type = other RNA
gagaacaactccttttatgga

SEQ ID NO: 1187 - RNA, 21 nt, synthetic construct
  misc_feature 1..21: note = RNAi agent sense strand modified sequence
  source 1..21: mol_type = other RNA
gagacaagcactaacactgta

SEQ ID NO: 1188 - RNA, 21 nt, synthetic construct
  misc_feature 1..21: note = RNAi agent sense strand modified sequence
  source 1..21: mol_type = other RNA
tcgtcatgagtatgtacacaa

SEQ ID NO: 1189 - RNA, 21 nt, synthetic construct
  misc_feature 1..21: note = RNAi agent sense strand modified sequence
  modified_base 19: mod_base = OTHER; note = 2'-O-methylinosine-3'-phosphate
  source 1..21: mol_type = other RNA
aggacatgctgataactgnta

SEQ ID NO: 1190 - RNA, 21 nt, synthetic construct
  misc_feature 1..21: note = RNAi agent sense strand modified sequence
  source 1..21: mol_type = other RNA
ggatacaaggttggcttcata

SEQ ID NO: 1191 - RNA, 21 nt, synthetic construct
  misc_feature 1..21: note = RNAi agent sense strand modified sequence
  source 1..21: mol_type = other RNA
gcaaggttggcttcatgaaga

SEQ ID NO: 1192 - RNA, 21 nt, synthetic construct
  misc_feature 1..21: note = RNAi agent sense strand modified sequence
  source 1..21: mol_type = other RNA
caaggttggcttcatgaagaa

SEQ ID NO: 1193 - RNA, 21 nt, synthetic construct
  misc_feature 1..21: note = RNAi agent sense strand modified sequence
  source 1..21: mol_type = other RNA
aggttggcttcatgaagacta

SEQ ID NO: 1194 - RNA, 21 nt, synthetic construct
  misc_feature 1..21: note = RNAi agent sense strand modified sequence
  source 1..21: mol_type = other RNA
aggagaattgttggaaaaaga

SEQ ID NO: 1195 - RNA, 21 nt, synthetic construct
  misc_feature 1..21: note = RNAi agent sense strand modified sequence
  source 1..21: mol_type = other RNA
gtggcttgctctgaagtagaa

SEQ ID NO: 1196 - RNA, 21 nt, synthetic construct
  misc_feature 1..21: note = RNAi agent sense strand modified sequence
  source 1..21: mol_type = other RNA
gcttgctctgaagtagaaata

SEQ ID NO: 1197 - RNA, 21 nt, synthetic construct
  misc_feature 1..21: note = RNAi agent sense strand modified sequence
  modified_base 17: mod_base = OTHER; note = 2'-O-methylinosine-3'-phosphate
  source 1..21: mol_type = other RNA
ccctgccattgatattngaca

SEQ ID NO: 1198 - RNA, 21 nt, synthetic construct
  misc_feature 1..21: note = RNAi agent sense strand modified sequence
  source 1..21: mol_type = other RNA
caagatcgtccacttttctga

SEQ ID NO: 1199 - RNA, 21 nt, synthetic construct
  misc_feature 1..21: note = RNAi agent sense strand modified sequence
  source 1..21: mol_type = other RNA
gtccgaagcagataatgttgt

SEQ ID NO: 1200 - RNA, 21 nt, synthetic construct
  misc_feature 1..21: note = RNAi agent sense strand modified sequence
  source 1..21: mol_type = other RNA
gtctctctcagagtattatga

SEQ ID NO: 1201 - RNA, 21 nt, synthetic construct
  misc_feature 1..21: note = RNAi agent sense strand modified sequence
  source 1..21: mol_type = other RNA
cccaccaagtttggaataaga

SEQ ID NO: 1202 - RNA, 21 nt, synthetic construct
  misc_feature 1..21: note = RNAi agent sense strand modified sequence
  source 1..21: mol_type = other RNA
ctgcataaagcaagattacta

SEQ ID NO: 1203 - RNA, 21 nt, synthetic construct
  misc_feature 1..21: note = RNAi agent sense strand modified sequence
  source 1..21: mol_type = other RNA
gacaatgttctagatttcttt

SEQ ID NO: 1204 - RNA, 21 nt, synthetic construct
  misc_feature 1..21: note = RNAi agent sense strand modified sequence
  source 1..21: mol_type = other RNA
caagatcgtccacttttctga

SEQ ID NO: 1205 - RNA, 21 nt, synthetic construct
  misc_feature 1..21: note = RNAi agent sense strand modified sequence
  source 1..21: mol_type = other RNA
gtctctctcagagtattatga

SEQ ID NO: 1206 - RNA, 21 nt, synthetic construct
  misc_feature 1..21: note = RNAi agent sense strand modified sequence
  source 1..21: mol_type = other RNA
gaaaatgttctagatttcttt

SEQ ID NO: 1207 - RNA, 21 nt, synthetic construct
  misc_feature 1..21: note = RNAi agent sense strand modified sequence
  source 1..21: mol_type = other RNA
agtgctggatgagtgaagtta

SEQ ID NO: 1208 - RNA, 21 nt, synthetic construct
  misc_feature 1..21: note = RNAi agent sense strand modified sequence
  modified_base 6: mod_base = OTHER; note = 2'-O-methylinosine-3'-phosphate
  source 1..21: mol_type = other RNA
gtgctngatgagtgaagttga

SEQ ID NO: 1209 - RNA, 21 nt, synthetic construct
  misc_feature 1..21: note = RNAi agent sense strand modified sequence
  modified_base 19: mod_base = OTHER; note = 2'-O-methylinosine-3'-phosphate
  source 1..21: mol_type = other RNA
tgctggatgagtgaagttnca

SEQ ID NO: 1210 - RNA, 21 nt, synthetic construct
  misc_feature 1..21: note = RNAi agent sense strand modified sequence
  source 1..21: mol_type = other RNA
gatgctctccaagtatgatca

SEQ ID NO: 1211 - RNA, 21 nt, synthetic construct
  misc_feature 1..21: note = RNAi agent sense strand modified sequence
  source 1..21: mol_type = other RNA
gtgatcgtctgcagaacaaga

SEQ ID NO: 1212 - RNA, 21 nt, synthetic construct
  misc_feature 1..21: note = RNAi agent sense strand modified sequence
  source 1..21: mol_type = other RNA
gtcgtctgcagaacaagatca

SEQ ID NO: 1213 - RNA, 21 nt, synthetic construct
  misc_feature 1..21: note = RNAi agent sense strand modified sequence
  source 1..21: mol_type = other RNA
gtcgccagtgcaactttacta

SEQ ID NO: 1214 - RNA, 21 nt, synthetic construct
  misc_feature 1..21: note = RNAi agent sense strand modified sequence
  source 1..21: mol_type = other RNA
aggataaggttacttgtgtta

SEQ ID NO: 1215 - RNA, 21 nt, synthetic construct
  misc_feature 1..21: note = RNAi agent sense strand modified sequence
  source 1..21: mol_type = other RNA
accagccattatcacaattga

SEQ ID NO: 1216 - RNA, 21 nt, synthetic construct
  misc_feature 1..21: note = RNAi agent sense strand modified sequence
  source 1..21: mol_type = other RNA
caagctctcagtatcatgcta

SEQ ID NO: 1217 - RNA, 21 nt, synthetic construct
  misc_feature 1..21: note = RNAi agent sense strand modified sequence
  source 1..21: mol_type = other RNA
gaagagtgaggttgacaagtt

SEQ ID NO: 1218 - RNA, 21 nt, synthetic construct
  misc_feature 1..21: note = RNAi agent sense strand modified sequence
  source 1..21: mol_type = other RNA
gagagtgaggttgacaagtta

SEQ ID NO: 1219 - RNA, 21 nt, synthetic construct
  misc_feature 1..21: note = RNAi agent sense strand modified sequence
  source 1..21: mol_type = other RNA
gttcaacaaggagaattgtta

SEQ ID NO: 1220 - RNA, 21 nt, synthetic construct
  misc_feature 1..21: note = RNAi agent sense strand modified sequence
  source 1..21: mol_type = other RNA
ggaacataccacagaacatga

SEQ ID NO: 1221 - RNA, 21 nt, synthetic construct
  misc_feature 1..21: note = RNAi agent sense strand modified sequence
  source 1..21: mol_type = other RNA
gaacatggatctattaaagta

SEQ ID NO: 1222 - RNA, 21 nt, synthetic construct
  misc_feature 1..21: note = RNAi agent sense strand modified sequence
  source 1..21: mol_type = other RNA
gacatggatctattaaagtca

SEQ ID NO: 1223 - RNA, 21 nt, synthetic construct
  misc_feature 1..21: note = RNAi agent sense strand modified sequence
  source 1..21: mol_type = other RNA
tgcctaaatggtgaatatgca

SEQ ID NO: 1224 - RNA, 21 nt, synthetic construct
  misc_feature 1..21: note = RNAi agent sense strand modified sequence
  source 1..21: mol_type = other RNA
gaacctctagaagcttaaaca

SEQ ID NO: 1225 - RNA, 21 nt, synthetic construct
  misc_feature 1..21: note = RNAi agent sense strand modified sequence
  source 1..21: mol_type = other RNA
ggccttcaaaccaatgaacaa

SEQ ID NO: 1226 - RNA, 21 nt, synthetic construct
  misc_feature 1..21: note = RNAi agent sense strand modified sequence
  source 1..21: mol_type = other RNA
ccaatgaacagcaaagcataa

SEQ ID NO: 1227 - RNA, 21 nt, synthetic construct
  misc_feature 1..21: note = RNAi agent sense strand modified sequence
  source 1..21: mol_type = other RNA
gatgaacagcaaagcataaca

SEQ ID NO: 1228 - RNA, 21 nt, synthetic construct
  misc_feature 1..21: note = RNAi agent sense strand modified sequence
  source 1..21: mol_type = other RNA
gtgaacagcaaagcataacct

SEQ ID NO: 1229 - RNA, 21 nt, synthetic construct
  misc_feature 1..21: note = RNAi agent sense strand modified sequence
  source 1..21: mol_type = other RNA
gaacagcaaagcataacctta

SEQ ID NO: 1230 - RNA, 21 nt, synthetic construct
  misc_feature 1..21: note = RNAi agent sense strand modified sequence
  source 1..21: mol_type = other RNA
gcaaagcataaccttgaatct

SEQ ID NO: 1231 - RNA, 21 nt, synthetic construct
  misc_feature 1..21: note = RNAi agent sense strand modified sequence
  source 1..21: mol_type = other RNA
ccaaccaactcaattattgaa

SEQ ID NO: 1232 - RNA, 21 nt, synthetic construct
  misc_feature 1..21: note = RNAi agent sense strand modified sequence
  source 1..21: mol_type = other RNA
cttcctgtgatccattttact

SEQ ID NO: 1233 - RNA, 21 nt, synthetic construct
  misc_feature 1..21: note = RNAi agent sense strand modified sequence
  source 1..21: mol_type = other RNA
ggttttcttactgtcatatga

SEQ ID NO: 1234 - RNA, 21 nt, synthetic construct
  misc_feature 1..21: note = RNAi agent sense strand modified sequence
  source 1..21: mol_type = other RNA
gagatcgagaatgccttccaa

SEQ ID NO: 1235 - RNA, 21 nt, synthetic construct
  misc_feature 1..21: note = RNAi agent sense strand modified sequence
  source 1..21: mol_type = other RNA
gactggcattttcaatgatga

SEQ ID NO: 1236 - RNA, 21 nt, synthetic construct
  misc_feature 1..21: note = RNAi agent sense strand modified sequence
  source 1..21: mol_type = other RNA
gtcaatgatgaaactgtcttt

SEQ ID NO: 1237 - RNA, 21 nt, synthetic construct
  misc_feature 1..21: note = RNAi agent sense strand modified sequence
  source 1..21: mol_type = other RNA
gaggatgaggttacttgtgtt

SEQ ID NO: 1238 - RNA, 21 nt, synthetic construct
  misc_feature 1..21: note = RNAi agent sense strand modified sequence
  source 1..21: mol_type = other RNA
ctgaagctgacaatgttgtct

SEQ ID NO: 1239 - RNA, 21 nt, synthetic construct
  misc_feature 1..21: note = RNAi agent sense strand modified sequence
  source 1..21: mol_type = other RNA
gctttattgcaaagatgttga

SEQ ID NO: 1240 - RNA, 21 nt, synthetic construct
  misc_feature 1..21: note = RNAi agent sense strand modified sequence
  source 1..21: mol_type = other RNA
gaggatttgtaagactaatct

SEQ ID NO: 1241 - RNA, 21 nt, synthetic construct
  misc_feature 1..21: note = RNAi agent sense strand modified sequence
  source 1..21: mol_type = other RNA
ccgactaagtttggaataaga

SEQ ID NO: 1242 - RNA, 21 nt, synthetic construct
  misc_feature 1..21: note = RNAi agent sense strand modified sequence
  source 1..21: mol_type = other RNA
gcttcacactttcttttctga

SEQ ID NO: 1243 - RNA, 21 nt, synthetic construct
  misc_feature 1..21: note = RNAi agent sense strand modified sequence
  source 1..21: mol_type = other RNA
gcagctttgagacaaactcta

SEQ ID NO: 1244 - RNA, 21 nt, synthetic construct
  misc_feature 1..21: note = RNAi agent sense strand modified sequence
  source 1..21: mol_type = other RNA
gagaaattgactgcttaacaa

SEQ ID NO: 1245 - RNA, 21 nt, synthetic construct
  misc_feature 1..21: note = RNAi agent sense strand modified sequence
  source 1..21: mol_type = other RNA
ccgtagtatccagatttccaa

SEQ ID NO: 1246 - RNA, 21 nt, synthetic construct
  misc_feature 1..21: note = RNAi agent sense strand modified sequence
  source 1..21: mol_type = other RNA
agcaggatggcattttcaaga

SEQ ID NO: 1247 - RNA, 21 nt, synthetic construct
  misc_feature 1..21: note = RNAi agent sense strand modified sequence
  source 1..21: mol_type = other RNA
gacaattgtgatccaaatcat

SEQ ID NO: 1248 - RNA, 21 nt, synthetic construct
  misc_feature 1..21: note = RNAi agent sense strand modified sequence
  source 1..21: mol_type = other RNA
tggcagttttgagtaattcta

SEQ ID NO: 1249 - RNA, 21 nt, synthetic construct
  misc_feature 1..21: note = RNAi agent sense strand modified sequence
  source 1..21: mol_type = other RNA
gtctgagtccatttttgatca

SEQ ID NO: 1250 - RNA, 21 nt, synthetic construct
  misc_feature 1..21: note = RNAi agent sense strand modified sequence
  source 1..21: mol_type = other RNA
ctagatctgcatgctttctta

SEQ ID NO: 1251 - RNA, 21 nt, synthetic construct
  misc_feature 1..21: note = RNAi agent sense strand modified sequence
  source 1..21: mol_type = other RNA
cttcagagagcttatatctga

SEQ ID NO: 1252 - RNA, 21 nt, synthetic construct
  misc_feature 1..21: note = RNAi agent sense strand modified sequence
  source 1..21: mol_type = other RNA
ggatacaaggttggcttcata

SEQ ID NO: 1253 - RNA, 21 nt, synthetic construct
  misc_feature 1..21: note = RNAi agent sense strand modified sequence
  modified_base 14: mod_base = OTHER; note = 2'-O-methylinosine-3'-phosphate
  source 1..21: mol_type = other RNA
ggatacaaggttgncttcata

SEQ ID NO: 1254 - RNA, 21 nt, synthetic construct
  misc_feature 1..21: note = RNAi agent sense strand modified sequence
  modified_base 13: mod_base = OTHER; note = 2'-O-methylinosine-3'-phosphate
  source 1..21: mol_type = other RNA
ggatacaaggttngcttcata

SEQ ID NO: 1255 - RNA, 21 nt, synthetic construct
  misc_feature 1..21: note = RNAi agent sense strand modified sequence
  source 1..21: mol_type = other RNA
ggatacaaggttggtttcata

SEQ ID NO: 1256 - RNA, 21 nt, synthetic construct
  misc_feature 1..21: note = RNAi agent sense strand modified sequence
  source 1..21: mol_type = other RNA
ggatacaaggttggcttcata

SEQ ID NO: 1257 - RNA, 21 nt, synthetic construct
  misc_feature 1..21: note = RNAi agent sense strand modified sequence
  source 1..21: mol_type = other RNA
ggatacaaggttggcttcata

SEQ ID NO: 1258 - RNA, 21 nt, synthetic construct
  misc_feature 1..21: note = RNAi agent sense strand modified sequence
  source 1..21: mol_type = other RNA
gcaaggttggcttcatgaaga

SEQ ID NO: 1259 - RNA, 21 nt, synthetic construct
  misc_feature 1..21: note = RNAi agent sense strand modified sequence
  modified_base 16: mod_base = OTHER; note = 2'-O-methylinosine-3'-phosphate
  source 1..21: mol_type = other RNA
gtggagaaaaatgcanatcca

SEQ ID NO: 1260 - RNA, 21 nt, synthetic construct
  misc_feature 1..21: note = RNAi agent sense strand modified sequence
  source 1..21: mol_type = other RNA
tccagagacaactcttttgga

SEQ ID NO: 1261 - RNA, 21 nt, synthetic construct
  misc_feature 1..21: note = RNAi agent sense strand modified sequence
  modified_base 17: mod_base = OTHER; note = 2'-O-methylinosine-3'-phosphate
  source 1..21: mol_type = other RNA
ctctccaagtatgatcntcta

SEQ ID NO: 1262 - RNA, 21 nt, synthetic construct
  misc_feature 1..21: note = RNAi agent sense strand modified sequence
  source 1..21: mol_type = other RNA
gcaactgtggaaggaatagga

SEQ ID NO: 1263 - RNA, 21 nt, synthetic construct
  misc_feature 1..21: note = RNAi agent sense strand modified sequence
  source 1..21: mol_type = other RNA
tggcatcgtcatgagtatgta

SEQ ID NO: 1264 - RNA, 21 nt, synthetic construct
  misc_feature 1..21: note = RNAi agent sense strand modified sequence
  modified_base 20: mod_base = OTHER; note = 2'-O-methylinosine-3'-phosphate
  source 1..21: mol_type = other RNA
gccttccaaggaaatctgtna

SEQ ID NO: 1265 - RNA, 21 nt, synthetic construct
  misc_feature 1..21: note = RNAi agent sense strand modified sequence
  source 1..21: mol_type = other RNA
gtggcattgagatgaagttca

SEQ ID NO: 1266 - RNA, 21 nt, synthetic construct
  misc_feature 1..21: note = RNAi agent sense strand modified sequence
  modified_base 2: mod_base = OTHER; note = 2'-O-methyl-2-aminoadenosine-3'-phosphate
  source 1..21: mol_type = other RNA
gntgaagttcaagaatatgct

SEQ ID NO: 1267 - RNA, 21 nt, synthetic construct
  misc_feature 1..21: note = RNAi agent sense strand modified sequence
  source 1..21: mol_type = other RNA
ggaatatgctgtttcctatga

SEQ ID NO: 1268 - RNA, 21 nt, synthetic construct
  misc_feature 1..21: note = RNAi agent sense strand modified sequence
  modified_base 16: mod_base = OTHER; note = 2'-O-methylinosine-3'-phosphate
  source 1..21: mol_type = other RNA
gctgctctccataganatcca

SEQ ID NO: 1269 - RNA, 21 nt, synthetic construct
  misc_feature 1..21: note = RNAi agent sense strand modified sequence
  source 1..21: mol_type = other RNA
gagtatttctcagcattcaaa

SEQ ID NO: 1270 - RNA, 21 nt, synthetic construct
  misc_feature 1..21: note = RNAi agent sense strand modified sequence
  source 1..21: mol_type = other RNA
cgccaagatcaagtccataga

SEQ ID NO: 1271 - RNA, 21 nt, synthetic construct
  misc_feature 1..21: note = RNAi agent sense strand modified sequence
  source 1..21: mol_type = other RNA
tccagggtttgtttgtttcat

SEQ ID NO: 1272 - RNA, 21 nt, synthetic construct
  misc_feature 1..21: note = RNAi agent sense strand modified sequence
  source 1..21: mol_type = other RNA
gtcacctatgaagaactacca

SEQ ID NO: 1273 - RNA, 21 nt, synthetic construct
  misc_feature 1..21: note = RNAi agent sense strand modified sequence
  source 1..21: mol_type = other RNA
gagaactaccagccattatca

SEQ ID NO: 1274 - RNA, 21 nt, synthetic construct
  misc_feature 1..21: note = RNAi agent sense strand modified sequence
  source 1..21: mol_type = other RNA
cagccattatcacaattgaga

SEQ ID NO: 1275 - RNA, 21 nt, synthetic construct
  misc_feature 1..21: note = RNAi agent sense strand modified sequence
  source 1..21: mol_type = other RNA
tgagctgaagatcgagaaaga

SEQ ID NO: 1276 - RNA, 21 nt, synthetic construct
  misc_feature 1..21: note = RNAi agent sense strand modified sequence
  source 1..21: mol_type = other RNA
ctgcaccattgctgttccaaa

SEQ ID NO: 1277 - RNA, 21 nt, synthetic construct
  misc_feature 1..21: note = RNAi agent sense strand modified sequence
  source 1..21: mol_type = other RNA
gtggagctctttgtgtttaca

SEQ ID NO: 1278 - RNA, 21 nt, synthetic construct
  misc_feature 1..21: note = RNAi agent sense strand modified sequence
  modified_base 20: mod_base = OTHER; note = 2'-O-methylinosine-3'-phosphate
  source 1..21: mol_type = other RNA
agctctttgtgtctacacana

SEQ ID NO: 1279 - RNA, 21 nt, synthetic construct
  misc_feature 1..21: note = RNAi agent sense strand modified sequence
  source 1..21: mol_type = other RNA
ctctctcagagtattatggaa

SEQ ID NO: 1280 - RNA, 21 nt, synthetic construct
  misc_feature 1..21: note = RNAi agent sense strand modified sequence
  modified_base 20: mod_base = OTHER; note = 2'-O-methylinosine-3'-phosphate
  source 1..21: mol_type = other RNA
gcagagtattatggaacgana

SEQ ID NO: 1281 - RNA, 21 nt, synthetic construct
  misc_feature 1..21: note = RNAi agent sense strand modified sequence
  source 1..21: mol_type = other RNA
tccagggtttgtttgtttcaa

SEQ ID NO: 1282 - RNA, 21 nt, synthetic construct
  misc_feature 1..21: note = RNAi agent sense strand modified sequence
  source 1..21: mol_type = other RNA
ccagggtttgtttgtttcatt

SEQ ID NO: 1283 - RNA, 21 nt, synthetic construct
  misc_feature 1..21: note = RNAi agent sense strand modified sequence
  source 1..21: mol_type = other RNA
cagggtttgtttgtttcattt

SEQ ID NO: 1284 - RNA, 21 nt, synthetic construct
  misc_feature 1..21: note = RNAi agent sense strand modified sequence
  source 1..21: mol_type = other RNA
gggtttgtttgtttcatttca

SEQ ID NO: 1285 - RNA, 21 nt, synthetic construct
  misc_feature 1..21: note = RNAi agent sense strand modified sequence
  source 1..21: mol_type = other RNA
tccagggtttgtttgtttcaa

SEQ ID NO: 1286 - RNA, 21 nt, synthetic construct
  misc_feature 1..21: note = RNAi agent sense strand modified sequence
  source 1..21: mol_type = other RNA
tccagggtttgtttgtttcaa

SEQ ID NO: 1287 - RNA, 21 nt, synthetic construct
  misc_feature 1..21: note = RNAi agent sense strand modified sequence
  modified_base 18: mod_base = OTHER; note = 2'-O-methylinosine-3'-phosphate
  source 1..21: mol_type = other RNA
gctctccaagtatgatcntct

SEQ ID NO: 1288 - RNA, 21 nt, synthetic construct
  misc_feature 1..21: note = RNAi agent sense strand modified sequence
  modified_base 17: mod_base = OTHER; note = 2'-O-methylinosine-3'-phosphate
  source 1..21: mol_type = other RNA
ggaggagattgagaatncctt

SEQ ID NO: 1289 - RNA, 21 nt, synthetic construct
  misc_feature 1..21: note = RNAi agent sense strand modified sequence
  source 1..21: mol_type = other RNA
cgagaatgccttccaaggaaa

SEQ ID NO: 1290 - RNA, 21 nt, synthetic construct
  misc_feature 1..21: note = RNAi agent sense strand modified sequence
  source 1..21: mol_type = other RNA
gatgccttccaaggaaatcta

SEQ ID NO: 1291 - RNA, 21 nt, synthetic construct
  misc_feature 1..21: note = RNAi agent sense strand modified sequence
  modified_base 2: mod_base = OTHER; note = 2'-O-methyl-2-aminoadenosine-3'-phosphate
  source 1..21: mol_type = other RNA
cnagaatatgctgtttcctat

SEQ ID NO: 1292 - RNA, 21 nt, synthetic construct
  misc_feature 1..21: note = RNAi agent sense strand modified sequence
  source 1..21: mol_type = other RNA
cgttggagggaacatcatcaa

SEQ ID NO: 1293 - RNA, 21 nt, synthetic construct
  misc_feature 1..21: note = RNAi agent sense strand modified sequence
  source 1..21: mol_type = other RNA
cagcttcttcttcaagttcta

SEQ ID NO: 1294 - RNA, 21 nt, synthetic construct
  misc_feature 1..21: note = RNAi agent sense strand modified sequence
  source 1..21: mol_type = other RNA
gtgttgggcatatcattggta

SEQ ID NO: 1295 - RNA, 21 nt, synthetic construct
  misc_feature 1..21: note = RNAi agent sense strand modified sequence
  source 1..21: mol_type = other RNA
cgtctacacagaacaccatga

SEQ ID NO: 1296 - RNA, 21 nt, synthetic construct
  misc_feature 1..21: note = RNAi agent sense strand modified sequence
  source 1..21: mol_type = other RNA
gacacccaggatctctttcaa

SEQ ID NO: 1297 - RNA, 21 nt, synthetic construct
  misc_feature 1..21: note = RNAi agent sense strand modified sequence
  source 1..21: mol_type = other RNA
agcaagctctcagtatcatga

SEQ ID NO: 1298 - RNA, 21 nt, synthetic construct
  misc_feature 1..21: note = RNAi agent sense strand modified sequence
  source 1..21: mol_type = other RNA
tcggaagagtgaggttgacaa

SEQ ID NO: 1299 - RNA, 21 nt, synthetic construct
  misc_feature 1..21: note = RNAi agent sense strand modified sequence
  source 1..21: mol_type = other RNA
gacaaggagaattgttggaaa

SEQ ID NO: 1300 - RNA, 21 nt, synthetic construct
  misc_feature 1..21: note = RNAi agent sense strand modified sequence
  source 1..21: mol_type = other RNA
gcagctttgagactaactcaa

SEQ ID NO: 1301 - RNA, 21 nt, synthetic construct
  misc_feature 1..21: note = RNAi agent sense strand modified sequence
  source 1..21: mol_type = other RNA
cctccgcacagatattgtcat

SEQ ID NO: 1302 - RNA, 21 nt, synthetic construct
  misc_feature 1..21: note = RNAi agent sense strand modified sequence
  source 1..21: mol_type = other RNA
tccgcacagatattgtcatga

SEQ ID NO: 1303 - RNA, 21 nt, synthetic construct
  misc_feature 1..21: note = RNAi agent sense strand modified sequence
  source 1..21: mol_type = other RNA
ggctgcttctatcttctttga

SEQ ID NO: 1304 - RNA, 21 nt, synthetic construct
  misc_feature 1..21: note = RNAi agent sense strand modified sequence
  modified_base 20: mod_base = OTHER; note = 2'-O-methylinosine-3'-phosphate
  source 1..21: mol_type = other RNA
agcacacaggtaataacgtna

SEQ ID NO: 1305 - RNA, 21 nt, synthetic construct
  misc_feature 1..21: note = RNAi agent sense strand modified sequence
  source 1..21: mol_type = other RNA
cctgtataacctcaagttcta

SEQ ID NO: 1306 - RNA, 21 nt, synthetic construct
  misc_feature 1..21: note = RNAi agent sense strand modified sequence
  source 1..21: mol_type = other RNA
gaccaatgaacagcaaagcat

SEQ ID NO: 1307 - RNA, 21 nt, synthetic construct
  misc_feature 1..21: note = RNAi agent sense strand modified sequence
  modified_base 2: mod_base = OTHER; note = 2'-O-methyl-2-aminoadenosine-3'-phosphate
  source 1..21: mol_type = other RNA
cntaaccttgaatctatacta

SEQ ID NO: 1308 - RNA, 21 nt, synthetic construct
  misc_feature 1..21: note = RNAi agent sense strand modified sequence
  source 1..21: mol_type = other RNA
ggcataaagcaagattactct

SEQ ID NO: 1309 - RNA, 21 nt, synthetic construct
  misc_feature 1..21: note = RNAi agent sense strand modified sequence
  source 1..21: mol_type = other RNA
tccacctagaaatgatgctat

SEQ ID NO: 1310 - RNA, 21 nt, synthetic construct
  misc_feature 1..21: note = RNAi agent sense strand modified sequence
  modified_base 18: mod_base = OTHER; note = 2'-O-methylinosine-3'-phosphate
  source 1..21: mol_type = other RNA
ctagctctgtctcttctntct

SEQ ID NO: 1311 - RNA, 21 nt, synthetic construct
  misc_feature 1..21: note = RNAi agent sense strand modified sequence
  modified_base 3: mod_base = OTHER; note = 2'-O-methyl-2-aminoadenosine-3'-phosphate
  source 1..21: mol_type = other RNA
ctnaggcttggttttcttact

SEQ ID NO: 1312 - RNA, 21 nt, synthetic construct
  misc_feature 1..21: note = RNAi agent sense strand modified sequence
  source 1..21: mol_type = other RNA
ctctctcagagtattatggaa

SEQ ID NO: 1313 - RNA, 21 nt, synthetic construct
  misc_feature 1..21: note = RNAi agent sense strand modified sequence
  source 1..21: mol_type = other RNA
ctctctcagagtattatggaa

SEQ ID NO: 1314 - RNA, 21 nt, synthetic construct
  misc_feature 1..21: note = RNAi agent sense strand modified sequence
  source 1..21: mol_type = other RNA
cagtgatgctctccaagtata

SEQ ID NO: 1315 - RNA, 21 nt, synthetic construct
  misc_feature 1..21: note = RNAi agent sense strand modified sequence
  modified_base 18: mod_base = OTHER; note = 2'-O-methylinosine-3'-phosphate
  source 1..21: mol_type = other RNA
gccaagtatgatcgtctncaa

SEQ ID NO: 1316 - RNA, 21 nt, synthetic construct
  misc_feature 1..21: note = RNAi agent sense strand modified sequence
  source 1..21: mol_type = other RNA
tggcatgagagttttattcaa

SEQ ID NO: 1317 - RNA, 21 nt, synthetic construct
  misc_feature 1..21: note = RNAi agent sense strand modified sequence
  modified_base 16: mod_base = OTHER; note = 2'-O-methyl-2-aminoadenosine-3'-phosphate
  source 1..21: mol_type = other RNA
tggcatgagagttttnttcaa

SEQ ID NO: 1318 - RNA, 21 nt, synthetic construct
  misc_feature 1..21: note = RNAi agent sense strand modified sequence
  source 1..21: mol_type = other RNA
cctcagcttcttcttcaagta

SEQ ID NO: 1319 - RNA, 21 nt, synthetic construct
  misc_feature 1..21: note = RNAi agent sense strand modified sequence
  source 1..21: mol_type = other RNA
cctcagcttcttctttaagta

SEQ ID NO: 1320 - RNA, 21 nt, synthetic construct
  misc_feature 1..21: note = RNAi agent sense strand modified sequence
  source 1..21: mol_type = other RNA
cctcagcttcttcttcaagta

SEQ ID NO: 1321 - RNA, 21 nt, synthetic construct
  misc_feature 1..21: note = RNAi agent sense strand modified sequence
  source 1..21: mol_type = other RNA
cctcagcttcttcttcaagta

SEQ ID NO: 1322 - RNA, 21 nt, synthetic construct
  misc_feature 1..21: note = RNAi agent sense strand modified sequence
  source 1..21: mol_type = other RNA
gagtatttctcagcattcaaa

SEQ ID NO: 1323 - RNA, 21 nt, synthetic construct
  misc_feature 1..21: note = RNAi agent sense strand modified sequence
  source 1..21: mol_type = other RNA
gacaagatcgtccacttttct

SEQ ID NO: 1324 - RNA, 21 nt, synthetic construct
  misc_feature 1..21: note = RNAi agent sense strand modified sequence
  source 1..21: mol_type = other RNA
accatgttgcagtgacaacta

SEQ ID NO: 1325 - RNA, 21 nt, synthetic construct
  misc_feature 1..21: note = RNAi agent sense strand modified sequence
  source 1..21: mol_type = other RNA
ggtgacaactgtggaaggaat

SEQ ID NO: 1326 - RNA, 21 nt, synthetic construct
  misc_feature 1..21: note = RNAi agent sense strand modified sequence
  source 1..21: mol_type = other RNA
gtggaggagattgagaatgca

SEQ ID NO: 1327 - RNA, 21 nt, synthetic construct
  misc_feature 1..21: note = RNAi agent sense strand modified sequence
  source 1..21: mol_type = other RNA
gacacggagattggcattgaa

SEQ ID NO: 1328 - RNA, 21 nt, synthetic construct
  misc_feature 1..21: note = RNAi agent sense strand modified sequence
  modified_base 20: mod_base = OTHER; note = 2'-O-methyl-2-aminoadenosine-3'-phosphate
  source 1..21: mol_type = other RNA
cgagatgaagttcaagaatnt

SEQ ID NO: 1329 - RNA, 21 nt, synthetic construct
  misc_feature 1..21: note = RNAi agent sense strand modified sequence
  source 1..21: mol_type = other RNA
aggagatactgctctccataa

SEQ ID NO: 1330 - RNA, 21 nt, synthetic construct
  misc_feature 1..21: note = RNAi agent sense strand modified sequence
  source 1..21: mol_type = other RNA
ggggagtatttctcagcatta

SEQ ID NO: 1331 - RNA, 21 nt, synthetic construct
  misc_feature 1..21: note = RNAi agent sense strand modified sequence
  source 1..21: mol_type = other RNA
gggagtatttctcagcattca

SEQ ID NO: 1332 - RNA, 21 nt, synthetic construct
  misc_feature 1..21: note = RNAi agent sense strand modified sequence
  source 1..21: mol_type = other RNA
ccggagagaagatgacattga

SEQ ID NO: 1333 - RNA, 21 nt, synthetic construct
  misc_feature 1..21: note = RNAi agent sense strand modified sequence
  source 1..21: mol_type = other RNA
ggtaacataactggaatttgt

SEQ ID NO: 1334 - RNA, 21 nt, synthetic construct
  misc_feature 1..21: note = RNAi agent sense strand modified sequence
  source 1..21: mol_type = other RNA
ccagccattatcacaattgaa

SEQ ID NO: 1335 - RNA, 21 nt, synthetic construct
  misc_feature 1..21: note = RNAi agent sense strand modified sequence
  source 1..21: mol_type = other RNA
gagctttgttgcaaaaatgtt

SEQ ID NO: 1336 - RNA, 21 nt, synthetic construct
  misc_feature 1..21: note = RNAi agent sense strand modified sequence
  source 1..21: mol_type = other RNA
gctttgttgcaaaaatgttga

SEQ ID NO: 1337 - RNA, 21 nt, synthetic construct
  misc_feature 1..21: note = RNAi agent sense strand modified sequence
  source 1..21: mol_type = other RNA
cggattgtggttcgagtgaaa

SEQ ID NO: 1338 - RNA, 21 nt, synthetic construct
  misc_feature 1..21: note = RNAi agent sense strand modified sequence
  source 1..21: mol_type = other RNA
cccaccaagtttggaataaga

SEQ ID NO: 1339 - RNA, 21 nt, synthetic construct
  misc_feature 1..21: note = RNAi agent sense strand modified sequence
  source 1..21: mol_type = other RNA
cccaccaagtttggaataaga

SEQ ID NO: 1340 - RNA, 21 nt, synthetic construct
  misc_feature 1..21: note = RNAi agent sense strand modified sequence
  source 1..21: mol_type = other RNA
tgcctaaatggtgaatatgca

SEQ ID NO: 1341 - RNA, 21 nt, synthetic construct
  misc_feature 1..21: note = RNAi agent sense strand modified sequence
  source 1..21: mol_type = other RNA
tgcctaaatggtgaatatgca

SEQ ID NO: 1342 - RNA, 21 nt, synthetic construct
  misc_feature 1..21: note = RNAi agent sense strand modified sequence
  source 1..21: mol_type = other RNA
tccagggtttgtttgtttcat

SEQ ID NO: 1343 - RNA, 21 nt, synthetic construct
  misc_feature 1..21: note = RNAi agent sense strand modified sequence
  source 1..21: mol_type = other RNA
gtctctcagagtattatggaa

SEQ ID NO: 1344 - RNA, 21 nt, synthetic construct
  misc_feature 1..21: note = RNAi agent sense strand modified sequence
  source 1..21: mol_type = other RNA
ccctctcagagtattatggaa

SEQ ID NO: 1345 - RNA, 21 nt, synthetic construct
  misc_feature 1..21: note = RNAi agent sense strand modified sequence
  source 1..21: mol_type = other RNA
gcctctcagagtattatggaa

SEQ ID NO: 1346 - RNA, 21 nt, synthetic construct
  misc_feature 1..21: note = RNAi agent sense strand modified sequence
  source 1..21: mol_type = other RNA
acctctcagagtattatggaa

SEQ ID NO: 1347 - RNA, 21 nt, synthetic construct
  misc_feature 1..21: note = RNAi agent sense strand modified sequence
  source 1..21: mol_type = other RNA
tcctctcagagtattatggaa

SEQ ID NO: 1348 - RNA, 21 nt, synthetic construct
  misc_feature 1..21: note = RNAi agent sense strand modified sequence
  source 1..21: mol_type = other RNA
cctccgcacagatattgtcat

SEQ ID NO: 1349 - RNA, 21 nt, synthetic construct
  misc_feature 1..21: note = RNAi agent sense strand modified sequence
  source 1..21: mol_type = other RNA
cctccgcacagatattgtcaa

SEQ ID NO: 1350 - RNA, 20 nt, synthetic construct
  misc_feature 1..20: note = RNAi agent sense strand modified sequence
  source 1..20: mol_type = other RNA
ctccgcacagatattgtcat

SEQ ID NO: 1351 - RNA, 19 nt, synthetic construct
  misc_feature 1..19: note = RNAi agent sense strand modified sequence
  source 1..19: mol_type = other RNA
tccgcacagatattgtcat

SEQ ID NO: 1352 - RNA, 21 nt, synthetic construct
  misc_feature 1..21: note = RNAi agent antisense strand underlying base sequence
  source 1..21: mol_type = other RNA
ttggaaggcattctcaatctc

SEQ ID NO: 1353 - RNA, 21 nt, synthetic construct
  misc_feature 1..21: note = RNAi agent antisense strand underlying base sequence
  source 1..21: mol_type = other RNA
aacttgaagaagaagctgagg

SEQ ID NO: 1354 - RNA, 21 nt, synthetic construct
  misc_feature 1..21: note = RNAi agent antisense strand underlying base sequence
  source 1..21: mol_type = other RNA
agaacttgaagaagaagctgc

SEQ ID NO: 1355 - RNA, 21 nt, synthetic construct
  misc_feature 1..21: note = RNAi agent antisense strand underlying base sequence
  source 1..21: mol_type = other RNA
tgtagaacttgaagaagaagc

SEQ ID NO: 1356 - RNA, 21 nt, synthetic construct
  misc_feature 1..21: note = RNAi agent antisense strand underlying base sequence
  source 1..21: mol_type = other RNA
tcataggtgattttcacccct

SEQ ID NO: 1357 - RNA, 21 nt, synthetic construct
  misc_feature 1..21: note = RNAi agent antisense strand underlying base sequence
  source 1..21: mol_type = other RNA
tttcataggtgattttcaccc

SEQ ID NO: 1358 - RNA, 21 nt, synthetic construct
  misc_feature 1..21: note = RNAi agent antisense strand underlying base sequence
  source 1..21: mol_type = other RNA
tcttcataggtgattttcacc

SEQ ID NO: 1359 - RNA, 21 nt, synthetic construct
  misc_feature 1..21: note = RNAi agent antisense strand underlying base sequence
  source 1..21: mol_type = other RNA
ttcttcataggtgattttcac

SEQ ID NO: 1360 - RNA, 21 nt, synthetic construct
  misc_feature 1..21: note = RNAi agent antisense strand underlying base sequence
  source 1..21: mol_type = other RNA
aattgtgataatggctggtag

SEQ ID NO: 1361 - RNA, 21 nt, synthetic construct
  misc_feature 1..21: note = RNAi agent antisense strand underlying base sequence
  source 1..21: mol_type = other RNA
tcataaaaggagttgttcttc

SEQ ID NO: 1362 - RNA, 21 nt, synthetic construct
  misc_feature 1..21: note = RNAi agent antisense strand underlying base sequence
  source 1..21: mol_type = other RNA
tccataaaaggagttgttctc

SEQ ID NO: 1363 - RNA, 21 nt, synthetic construct
  misc_feature 1..21: note = RNAi agent antisense strand underlying base sequence
  source 1..21: mol_type = other RNA
tacagtgttagtgcttgtctc

SEQ ID NO: 1364 - RNA, 21 nt, synthetic construct
  misc_feature 1..21: note = RNAi agent antisense strand underlying base sequence
  source 1..21: mol_type = other RNA
ttgtgtacatactcatgacga

SEQ ID NO: 1365 - RNA, 21 nt, synthetic construct
  misc_feature 1..21: note = RNAi agent antisense strand underlying base sequence
  source 1..21: mol_type = other RNA
taccagttatcagcatgtcct

SEQ ID NO: 1366 - RNA, 21 nt, synthetic construct
  misc_feature 1..21: note = RNAi agent antisense strand underlying base sequence
  source 1..21: mol_type = other RNA
tatgaagccaaccttgtatcc

SEQ ID NO: 1367 - RNA, 21 nt, synthetic construct
  misc_feature 1..21: note = RNAi agent antisense strand underlying base sequence
  source 1..21: mol_type = other RNA
tcttcatgaagccaaccttgc

SEQ ID NO: 1368 - RNA, 21 nt, synthetic construct
  misc_feature 1..21: note = RNAi agent antisense strand underlying base sequence
  source 1..21: mol_type = other RNA
ttcttcatgaagccaaccttg

SEQ ID NO: 1369 - RNA, 21 nt, synthetic construct
  misc_feature 1..21: note = RNAi agent antisense strand underlying base sequence
  source 1..21: mol_type = other RNA
tagtcttcatgaagccaacct

SEQ ID NO: 1370 - RNA, 21 nt, synthetic construct
  misc_feature 1..21: note = RNAi agent antisense strand underlying base sequence
  source 1..21: mol_type = other RNA
tctttttccaacaattctcct

SEQ ID NO: 1371 - RNA, 21 nt, synthetic construct
  misc_feature 1..21: note = RNAi agent antisense strand underlying base sequence
  source 1..21: mol_type = other RNA
ttctacttcagagcaagccac

SEQ ID NO: 1372 - RNA, 21 nt, synthetic construct
  misc_feature 1..21: note = RNAi agent antisense strand underlying base sequence
  source 1..21: mol_type = other RNA
tatttctacttcagagcaagc

SEQ ID NO: 1373 - RNA, 21 nt, synthetic construct
  misc_feature 1..21: note = RNAi agent antisense strand underlying base sequence
  source 1..21: mol_type = other RNA
tgtccaatatcaatggcaggg

SEQ ID NO: 1374 - RNA, 21 nt, synthetic construct
  misc_feature 1..21: note = RNAi agent antisense strand underlying base sequence
  source 1..21: mol_type = other RNA
tcagaaaagtggacgatcttg

SEQ ID NO: 1375 - RNA, 21 nt, synthetic construct
  misc_feature 1..21: note = RNAi agent antisense strand underlying base sequence
  source 1..21: mol_type = other RNA
acaacattatctgcttcggac

SEQ ID NO: 1376 - RNA, 21 nt, synthetic construct
  misc_feature 1..21: note = RNAi agent antisense strand underlying base sequence
  source 1..21: mol_type = other RNA
tcataatactctgagagagac

SEQ ID NO: 1377 - RNA, 21 nt, synthetic construct
  misc_feature 1..21: note = RNAi agent antisense strand underlying base sequence
  source 1..21: mol_type = other RNA
tcttattccaaacttggtggg

SEQ ID NO: 1378 - RNA, 21 nt, synthetic construct
  misc_feature 1..21: note = RNAi agent antisense strand underlying base sequence
  source 1..21: mol_type = other RNA
tagtaatcttgctttatgcag

SEQ ID NO: 1379 - RNA, 21 nt, synthetic construct
  misc_feature 1..21: note = RNAi agent antisense strand underlying base sequence
  source 1..21: mol_type = other RNA
aaagaaatctagaacattgtc

SEQ ID NO: 1380 - RNA, 21 nt, synthetic construct
  misc_feature 1..21: note = RNAi agent antisense strand underlying base sequence
  source 1..21: mol_type = other RNA
aaagaaatctagaacattttc

SEQ ID NO: 1381 - RNA, 21 nt, synthetic construct
  misc_feature 1..21: note = RNAi agent antisense strand underlying base sequence
  source 1..21: mol_type = other RNA
taacttcactcatccagcact

SEQ ID NO: 1382 - RNA, 21 nt, synthetic construct
  misc_feature 1..21: note = RNAi agent antisense strand underlying base sequence
  source 1..21: mol_type = other RNA
tcaacttcactcatccagcac

SEQ ID NO: 1383 - RNA, 21 nt, synthetic construct
  misc_feature 1..21: note = RNAi agent antisense strand underlying base sequence
  source 1..21: mol_type = other RNA
tgcaacttcactcatccagca

SEQ ID NO: 1384 - RNA, 21 nt, synthetic construct
  misc_feature 1..21: note = RNAi agent antisense strand underlying base sequence
  source 1..21: mol_type = other RNA
tgatcatacttggagagcatc

SEQ ID NO: 1385 - RNA, 21 nt, synthetic construct
  misc_feature 1..21: note = RNAi agent antisense strand underlying base sequence
  source 1..21: mol_type = other RNA
tcttgttctgcagacgatcac

SEQ ID NO: 1386 - RNA, 21 nt, synthetic construct
  misc_feature 1..21: note = RNAi agent antisense strand underlying base sequence
  source 1..21: mol_type = other RNA
tgatcttgttctgcagacgac

SEQ ID NO: 1387 - RNA, 21 nt, synthetic construct
  misc_feature 1..21: note = RNAi agent antisense strand underlying base sequence
  source 1..21: mol_type = other RNA
tagtaaagttgcactggcgac

SEQ ID NO: 1388 - RNA, 21 nt, synthetic construct
  misc_feature 1..21: note = RNAi agent antisense strand underlying base sequence
  source 1..21: mol_type = other RNA
taacacaagtaaccttatcct

SEQ ID NO: 1389 - RNA, 21 nt, synthetic construct
  misc_feature 1..21: note = RNAi agent antisense strand underlying base sequence
  source 1..21: mol_type = other RNA
tcaattgtgataatggctggt

SEQ ID NO: 1390 - RNA, 21 nt, synthetic construct
  misc_feature 1..21: note = RNAi agent antisense strand underlying base sequence
  source 1..21: mol_type = other RNA
tagcatgatactgagagcttg

SEQ ID NO: 1391 - RNA, 21 nt, synthetic construct
  misc_feature 1..21: note = RNAi agent antisense strand underlying base sequence
  source 1..21: mol_type = other RNA
aacttgtcaacctcactcttc

SEQ ID NO: 1392 - RNA, 21 nt, synthetic construct
  misc_feature 1..21: note = RNAi agent antisense strand underlying base sequence
  source 1..21: mol_type = other RNA
taacttgtcaacctcactctc

SEQ ID NO: 1393 - RNA, 21 nt, synthetic construct
  misc_feature 1..21: note = RNAi agent antisense strand underlying base sequence
  source 1..21: mol_type = other RNA
taacaattctccttgttgaac

SEQ ID NO: 1394 - RNA, 21 nt, synthetic construct
  misc_feature 1..21: note = RNAi agent antisense strand underlying base sequence
  source 1..21: mol_type = other RNA
tcatgttctgtggtatgttcc

SEQ ID NO: 1395 - RNA, 21 nt, synthetic construct
  misc_feature 1..21: note = RNAi agent antisense strand underlying base sequence
  source 1..21: mol_type = other RNA
tactttaatagatccatgttc

SEQ ID NO: 1396 - RNA, 21 nt, synthetic construct
  misc_feature 1..21: note = RNAi agent antisense strand underlying base sequence
  source 1..21: mol_type = other RNA
tgactttaatagatccatgtc

SEQ ID NO: 1397 - RNA, 21 nt, synthetic construct
  misc_feature 1..21: note = RNAi agent antisense strand underlying base sequence
  source 1..21: mol_type = other RNA
tgcatattcaccatttaggca

SEQ ID NO: 1398 - RNA, 21 nt, synthetic construct
  misc_feature 1..21: note = RNAi agent antisense strand underlying base sequence
  source 1..21: mol_type = other RNA
tgtttaagcttctagaggttc

SEQ ID NO: 1399 - RNA, 21 nt, synthetic construct
  misc_feature 1..21: note = RNAi agent antisense strand underlying base sequence
  source 1..21: mol_type = other RNA
ttgttcattggtttgaaggcc

SEQ ID NO: 1400 - RNA, 21 nt, synthetic construct
  misc_feature 1..21: note = RNAi agent antisense strand underlying base sequence
  source 1..21: mol_type = other RNA
ttatgctttgctgttcattgg

SEQ ID NO: 1401 - RNA, 21 nt, synthetic construct
  misc_feature 1..21: note = RNAi agent antisense strand underlying base sequence
  source 1..21: mol_type = other RNA
tgttatgctttgctgttcatc

SEQ ID NO: 1402 - RNA, 21 nt, synthetic construct
  misc_feature 1..21: note = RNAi agent antisense strand underlying base sequence
  source 1..21: mol_type = other RNA
aggttatgctttgctgttcac

SEQ ID NO: 1403 - RNA, 21 nt, synthetic construct
  misc_feature 1..21: note = RNAi agent antisense strand underlying base sequence
  source 1..21: mol_type = other RNA
taaggttatgctttgctgttc

SEQ ID NO: 1404 - RNA, 21 nt, synthetic construct
  misc_feature 1..21: note = RNAi agent antisense strand underlying base sequence
  source 1..21: mol_type = other RNA
agattcaaggttatgctttgc

SEQ ID NO: 1405 - RNA, 21 nt, synthetic construct
  misc_feature 1..21: note = RNAi agent antisense strand underlying base sequence
  source 1..21: mol_type = other RNA
ttcaataattgagttggttgg

SEQ ID NO: 1406 - RNA, 21 nt, synthetic construct
  misc_feature 1..21: note = RNAi agent antisense strand underlying base sequence
  source 1..21: mol_type = other RNA
agtaaaatggatcacaggaag

SEQ ID NO: 1407 - RNA, 21 nt, synthetic construct
  misc_feature 1..21: note = RNAi agent antisense strand underlying base sequence
  source 1..21: mol_type = other RNA
tcatatgacagtaagaaaacc

SEQ ID NO: 1408 - RNA, 21 nt, synthetic construct
  misc_feature 1..21: note = RNAi agent antisense strand underlying base sequence
  source 1..21: mol_type = other RNA
ttggaaggcattctcgatctc

SEQ ID NO: 1409 - RNA, 21 nt, synthetic construct
  misc_feature 1..21: note = RNAi agent antisense strand underlying base sequence
  source 1..21: mol_type = other RNA
tcatcattgaaaatgccagtc

SEQ ID NO: 1410 - RNA, 21 nt, synthetic construct
  misc_feature 1..21: note = RNAi agent antisense strand underlying base sequence
  source 1..21: mol_type = other RNA
aaagacagtttcatcattgac

SEQ ID NO: 1411 - RNA, 21 nt, synthetic construct
  misc_feature 1..21: note = RNAi agent antisense strand underlying base sequence
  source 1..21: mol_type = other RNA
aacacaagtaacctcatcctc

SEQ ID NO: 1412 - RNA, 21 nt, synthetic construct
  misc_feature 1..21: note = RNAi agent antisense strand underlying base sequence
  source 1..21: mol_type = other RNA
agacaacattgtcagcttcag

SEQ ID NO: 1413 - RNA, 21 nt, synthetic construct
  misc_feature 1..21: note = RNAi agent antisense strand underlying base sequence
  source 1..21: mol_type = other RNA
tcaacatctttgcaataaagc

SEQ ID NO: 1414 - RNA, 21 nt, synthetic construct
  misc_feature 1..21: note = RNAi agent antisense strand underlying base sequence
  source 1..21: mol_type = other RNA
agattagtcttacaaatcctc

SEQ ID NO: 1415 - RNA, 21 nt, synthetic construct
  misc_feature 1..21: note = RNAi agent antisense strand underlying base sequence
  source 1..21: mol_type = other RNA
tcttattccaaacttagtcgg

SEQ ID NO: 1416 - RNA, 21 nt, synthetic construct
  misc_feature 1..21: note = RNAi agent antisense strand underlying base sequence
  source 1..21: mol_type = other RNA
tcagaaaagaaagtgtgaagc

SEQ ID NO: 1417 - RNA, 21 nt, synthetic construct
  misc_feature 1..21: note = RNAi agent antisense strand underlying base sequence
  source 1..21: mol_type = other RNA
tagagtttgtctcaaagctgc

SEQ ID NO: 1418 - RNA, 21 nt, synthetic construct
  misc_feature 1..21: note = RNAi agent antisense strand underlying base sequence
  source 1..21: mol_type = other RNA
ttgttaagcagtcaatttctc

SEQ ID NO: 1419 - RNA, 21 nt, synthetic construct
  misc_feature 1..21: note = RNAi agent antisense strand underlying base sequence
  source 1..21: mol_type = other RNA
ttggaaatctggatactacgg

SEQ ID NO: 1420 - RNA, 21 nt, synthetic construct
  misc_feature 1..21: note = RNAi agent antisense strand underlying base sequence
  source 1..21: mol_type = other RNA
tcttgaaaatgccatcctgct

SEQ ID NO: 1421 - RNA, 21 nt, synthetic construct
  misc_feature 1..21: note = RNAi agent antisense strand underlying base sequence
  source 1..21: mol_type = other RNA
atgatttggatcacaattgtc

SEQ ID NO: 1422 - RNA, 21 nt, synthetic construct
  misc_feature 1..21: note = RNAi agent antisense strand underlying base sequence
  source 1..21: mol_type = other RNA
tagaattactcaaaactgcca

SEQ ID NO: 1423 - RNA, 21 nt, synthetic construct
  misc_feature 1..21: note = RNAi agent antisense strand underlying base sequence
  source 1..21: mol_type = other RNA
tgatcaaaaatggactcagac

SEQ ID NO: 1424 - RNA, 21 nt, synthetic construct
  misc_feature 1..21: note = RNAi agent antisense strand underlying base sequence
  source 1..21: mol_type = other RNA
taagaaagcatgcagatctag

SEQ ID NO: 1425 - RNA, 21 nt, synthetic construct
  misc_feature 1..21: note = RNAi agent antisense strand underlying base sequence
  source 1..21: mol_type = other RNA
tcagatataagctctctgaag

SEQ ID NO: 1426 - RNA, 21 nt, synthetic construct
  misc_feature 1..21: note = RNAi agent antisense strand underlying base sequence
  source 1..21: mol_type = other RNA
tatgaagtcaaccttgtatcc

SEQ ID NO: 1427 - RNA, 21 nt, synthetic construct
  misc_feature 1..21: note = RNAi agent antisense strand underlying base sequence
  source 1..21: mol_type = other RNA
tatgaagctaaccttgtatcc

SEQ ID NO: 1428 - RNA, 21 nt, synthetic construct
  misc_feature 1..21: note = RNAi agent antisense strand underlying base sequence
  source 1..21: mol_type = other RNA
tggatctgcatttttctccac

SEQ ID NO: 1429 - RNA, 21 nt, synthetic construct
  misc_feature 1..21: note = RNAi agent antisense strand underlying base sequence
  source 1..21: mol_type = other RNA
tccaaaagggttgtctctgga

SEQ ID NO: 1430 - RNA, 21 nt, synthetic construct
  misc_feature 1..21: note = RNAi agent antisense strand underlying base sequence
  source 1..21: mol_type = other RNA
tagacgatcatacttggagag

SEQ ID NO: 1431 - RNA, 21 nt, synthetic construct
  misc_feature 1..21: note = RNAi agent antisense strand underlying base sequence
  source 1..21: mol_type = other RNA
tcctattccttccacagttgc

SEQ ID NO: 1432 - RNA, 21 nt, synthetic construct
  misc_feature 1..21: note = RNAi agent antisense strand underlying base sequence
  source 1..21: mol_type = other RNA
tacatactcatgacgatgcca

SEQ ID NO: 1433 - RNA, 21 nt, synthetic construct
  misc_feature 1..21: note = RNAi agent antisense strand underlying base sequence
  source 1..21: mol_type = other RNA
tcacagatttccttggaaggc

SEQ ID NO: 1434 - RNA, 21 nt, synthetic construct
  misc_feature 1..21: note = RNAi agent antisense strand underlying base sequence
  source 1..21: mol_type = other RNA
tgaacttcatctcaatgccac

SEQ ID NO: 1435 - RNA, 21 nt, synthetic construct
  misc_feature 1..21: note = RNAi agent antisense strand underlying base sequence
  source 1..21: mol_type = other RNA
agcatattcttgaacttcatc

SEQ ID NO: 1436 - RNA, 21 nt, synthetic construct
  misc_feature 1..21: note = RNAi agent antisense strand underlying base sequence
  source 1..21: mol_type = other RNA
tcataggaaacagcatattcc

SEQ ID NO: 1437 - RNA, 21 nt, synthetic construct
  misc_feature 1..21: note = RNAi agent antisense strand underlying base sequence
  source 1..21: mol_type = other RNA
tggatctctatggagagcagc

SEQ ID NO: 1438 - RNA, 21 nt, synthetic construct
  misc_feature 1..21: note = RNAi agent antisense strand underlying base sequence
  source 1..21: mol_type = other RNA
tttgaatgctgagaaatactc

SEQ ID NO: 1439 - RNA, 21 nt, synthetic construct
  misc_feature 1..21: note = RNAi agent antisense strand underlying base sequence
  source 1..21: mol_type = other RNA
tctatggacttgatcttggcg

SEQ ID NO: 1440 - RNA, 21 nt, synthetic construct
  misc_feature 1..21: note = RNAi agent antisense strand underlying base sequence
  source 1..21: mol_type = other RNA
atgaaacaaacaaaccctgga

SEQ ID NO: 1441 - RNA, 21 nt, synthetic construct
  misc_feature 1..21: note = RNAi agent antisense strand underlying base sequence
  source 1..21: mol_type = other RNA
tggtagttcttcataggtgac

SEQ ID NO: 1442 - RNA, 21 nt, synthetic construct
  misc_feature 1..21: note = RNAi agent antisense strand underlying base sequence
  source 1..21: mol_type = other RNA
tgataatggctggtagttctc

SEQ ID NO: 1443 - RNA, 21 nt, synthetic construct
  misc_feature 1..21: note = RNAi agent antisense strand underlying base sequence
  source 1..21: mol_type = other RNA
tctcaattgtgataatggctg

SEQ ID NO: 1444 - RNA, 21 nt, synthetic construct
  misc_feature 1..21: note = RNAi agent antisense strand underlying base sequence
  source 1..21: mol_type = other RNA
tctttctcgatcttcagctca

SEQ ID NO: 1445 - RNA, 21 nt, synthetic construct
  misc_feature 1..21: note = RNAi agent antisense strand underlying base sequence
  source 1..21: mol_type = other RNA
tttggaacagcaatggtgcag

SEQ ID NO: 1446 - RNA, 21 nt, synthetic construct
  misc_feature 1..21: note = RNAi agent antisense strand underlying base sequence
  source 1..21: mol_type = other RNA
tgtagacacaaagagctccac

SEQ ID NO: 1447 - RNA, 21 nt, synthetic construct
  misc_feature 1..21: note = RNAi agent antisense strand underlying base sequence
  source 1..21: mol_type = other RNA
tctgtgtagacacaaagagct

SEQ ID NO: 1448 - RNA, 21 nt, synthetic construct
  misc_feature 1..21: note = RNAi agent antisense strand underlying base sequence
  source 1..21: mol_type = other RNA
ttccataatactctgagagag

SEQ ID NO: 1449 - RNA, 21 nt, synthetic construct
  misc_feature 1..21: note = RNAi agent antisense strand underlying base sequence
  source 1..21: mol_type = other RNA
tctcgttccataatactctgc

SEQ ID NO: 1450 - RNA, 21 nt, synthetic construct
  misc_feature 1..21: note = RNAi agent antisense strand underlying base sequence
  source 1..21: mol_type = other RNA
ttgaaacaaacaaaccctgga

SEQ ID NO: 1451 - RNA, 21 nt, synthetic construct
  misc_feature 1..21: note = RNAi agent antisense strand underlying base sequence
  source 1..21: mol_type = other RNA
aatgaaacaaacaaaccctgg

SEQ ID NO: 1452 - RNA, 21 nt, synthetic construct
  misc_feature 1..21: note = RNAi agent antisense strand underlying base sequence
  source 1..21: mol_type = other RNA
aaatgaaacaaacaaaccctg

SEQ ID NO: 1453 - RNA, 21 nt, synthetic construct
  misc_feature 1..21: note = RNAi agent antisense strand underlying base sequence
  source 1..21: mol_type = other RNA
tgaaatgaaacaaacaaaccc

SEQ ID NO: 1454 - RNA, 21 nt, synthetic construct
  misc_feature 1..21: note = RNAi agent antisense strand underlying base sequence
  source 1..21: mol_type = other RNA
agacgatcatacttggagagc

SEQ ID NO: 1455 - RNA, 21 nt, synthetic construct
  misc_feature 1..21: note = RNAi agent antisense strand underlying base sequence
  source 1..21: mol_type = other RNA
aaggcattctcaatctcctcc

SEQ ID NO: 1456 - RNA, 21 nt, synthetic construct
  misc_feature 1..21: note = RNAi agent antisense strand underlying base sequence
  source 1..21: mol_type = other RNA
tttccttggaaggcattctcg

SEQ ID NO: 1457 - RNA, 21 nt, synthetic construct
  misc_feature 1..21: note = RNAi agent antisense strand underlying base sequence
  source 1..21: mol_type = other RNA
tagatttccttggaaggcatc

SEQ ID NO: 1458 - RNA, 21 nt, synthetic construct
  misc_feature 1..21: note = RNAi agent antisense strand underlying base sequence
  source 1..21: mol_type = other RNA
ataggaaacagcatattcttg

SEQ ID NO: 1459 - RNA, 21 nt, synthetic construct
  misc_feature 1..21: note = RNAi agent antisense strand underlying base sequence
  source 1..21: mol_type = other RNA
ttgatgatgttccctccaacg

SEQ ID NO: 1460 - RNA, 21 nt, synthetic construct
  misc_feature 1..21: note = RNAi agent antisense strand underlying base sequence
  source 1..21: mol_type = other RNA
tagaacttgaagaagaagctg

SEQ ID NO: 1461 - RNA, 21 nt, synthetic construct
  misc_feature 1..21: note = RNAi agent antisense strand underlying base sequence
  source 1..21: mol_type = other RNA
taccaatgatatgcccaacac

SEQ ID NO: 1462 - RNA, 21 nt, synthetic construct
  misc_feature 1..21: note = RNAi agent antisense strand underlying base sequence
  source 1..21: mol_type = other RNA
tcatggtgttctgtgtagacg

SEQ ID NO: 1463 - RNA, 21 nt, synthetic construct
  misc_feature 1..21: note = RNAi agent antisense strand underlying base sequence
  source 1..21: mol_type = other RNA
ttgagagagatcctgggtgtc

SEQ ID NO: 1464 - RNA, 21 nt, synthetic construct
  misc_feature 1..21: note = RNAi agent antisense strand underlying base sequence
  source 1..21: mol_type = other RNA
tcatgatactgagagcttgct

SEQ ID NO: 1465 - RNA, 21 nt, synthetic construct
  misc_feature 1..21: note = RNAi agent antisense strand underlying base sequence
  source 1..21: mol_type = other RNA
ttgtcaacctcactcttccga

SEQ ID NO: 1466 - RNA, 21 nt, synthetic construct
  misc_feature 1..21: note = RNAi agent antisense strand underlying base sequence
  source 1..21: mol_type = other RNA
tttccaacaattctccttgtc

SEQ ID NO: 1467 - RNA, 21 nt, synthetic construct
  misc_feature 1..21: note = RNAi agent antisense strand underlying base sequence
  source 1..21: mol_type = other RNA
ttgagttagtctcaaagctgc

SEQ ID NO: 1468 - RNA, 21 nt, synthetic construct
  misc_feature 1..21: note = RNAi agent antisense strand underlying base sequence
  source 1..21: mol_type = other RNA
atgacaatatctgtgcggagg

SEQ ID NO: 1469 - RNA, 21 nt, synthetic construct
  misc_feature 1..21: note = RNAi agent antisense strand underlying base sequence
  source 1..21: mol_type = other RNA
tcatgacaatatctgtgcgga

SEQ ID NO: 1470 - RNA, 21 nt, synthetic construct
  misc_feature 1..21: note = RNAi agent antisense strand underlying base sequence
  source 1..21: mol_type = other RNA
tcaaagaagatagaagcagcc

SEQ ID NO: 1471 - RNA, 21 nt, synthetic construct
  misc_feature 1..21: note = RNAi agent antisense strand underlying base sequence
  source 1..21: mol_type = other RNA
tcacgttattacctgtgtgct

SEQ ID NO: 1472 - RNA, 21 nt, synthetic construct
  misc_feature 1..21: note = RNAi agent antisense strand underlying base sequence
  source 1..21: mol_type = other RNA
tagaacttgaggttatacagg

SEQ ID NO: 1473 - RNA, 21 nt, synthetic construct
  misc_feature 1..21: note = RNAi agent antisense strand underlying base sequence
  source 1..21: mol_type = other RNA
atgctttgctgttcattggtc

SEQ ID NO: 1474 - RNA, 21 nt, synthetic construct
  misc_feature 1..21: note = RNAi agent antisense strand underlying base sequence
  source 1..21: mol_type = other RNA
tagtatagattcaaggttatg

SEQ ID NO: 1475 - RNA, 21 nt, synthetic construct
  misc_feature 1..21: note = RNAi agent antisense strand underlying base sequence
  source 1..21: mol_type = other RNA
agagtaatcttgctttatgcc

SEQ ID NO: 1476 - RNA, 21 nt, synthetic construct
  misc_feature 1..21: note = RNAi agent antisense strand underlying base sequence
  source 1..21: mol_type = other RNA
atagcatcatttctaggtgga

SEQ ID NO: 1477 - RNA, 21 nt, synthetic construct
  misc_feature 1..21: note = RNAi agent antisense strand underlying base sequence
  source 1..21: mol_type = other RNA
agacagaagagacagagctag

SEQ ID NO: 1478 - RNA, 21 nt, synthetic construct
  misc_feature 1..21: note = RNAi agent antisense strand underlying base sequence
  source 1..21: mol_type = other RNA
agtaagaaaaccaagccttag

SEQ ID NO: 1479 - RNA, 21 nt, synthetic construct
  misc_feature 1..21: note = RNAi agent antisense strand underlying base sequence
  source 1..21: mol_type = other RNA
tatacttggagagcatcactg

SEQ ID NO: 1480 - RNA, 21 nt, synthetic construct
  misc_feature 1..21: note = RNAi agent antisense strand underlying base sequence
  source 1..21: mol_type = other RNA
ttgcagacgatcatacttggc

SEQ ID NO: 1481 - RNA, 21 nt, synthetic construct
  misc_feature 1..21: note = RNAi agent antisense strand underlying base sequence
  source 1..21: mol_type = other RNA
ttgaataaaactctcatgcca

SEQ ID NO: 1482 - RNA, 21 nt, synthetic construct
  misc_feature 1..21: note = RNAi agent antisense strand underlying base sequence
  source 1..21: mol_type = other RNA
tacttgaagaagaagctgagg

SEQ ID NO: 1483 - RNA, 21 nt, synthetic construct
  misc_feature 1..21: note = RNAi agent antisense strand underlying base sequence
  source 1..21: mol_type = other RNA
agaaaagtggacgatcttgtc

SEQ ID NO: 1484 - RNA, 21 nt, synthetic construct
  misc_feature 1..21: note = RNAi agent antisense strand underlying base sequence
  source 1..21: mol_type = other RNA
tagttgtcactgcaacatggt

SEQ ID NO: 1485 - RNA, 21 nt, synthetic construct
  misc_feature 1..21: note = RNAi agent antisense strand underlying base sequence
  source 1..21: mol_type = other RNA
attccttccacagttgtcacc

SEQ ID NO: 1486 - RNA, 21 nt, synthetic construct
  misc_feature 1..21: note = RNAi agent antisense strand underlying base sequence
  source 1..21: mol_type = other RNA
tgcattctcaatctcctccac

SEQ ID NO: 1487 - RNA, 21 nt, synthetic construct
  misc_feature 1..21: note = RNAi agent antisense strand underlying base sequence
  source 1..21: mol_type = other RNA
ttcaatgccaatctccgtgtc

SEQ ID NO: 1488 - RNA, 21 nt, synthetic construct
  misc_feature 1..21: note = RNAi agent antisense strand underlying base sequence
  source 1..21: mol_type = other RNA
atattcttgaacttcatctcg

SEQ ID NO: 1489 - RNA, 21 nt, synthetic construct
  misc_feature 1..21: note = RNAi agent antisense strand underlying base sequence
  source 1..21: mol_type = other RNA
ttatggagagcagtatctcct

SEQ ID NO: 1490 - RNA, 21 nt, synthetic construct
  misc_feature 1..21: note = RNAi agent antisense strand underlying base sequence
  source 1..21: mol_type = other RNA
taatgctgagaaatactcccc

SEQ ID NO: 1491 - RNA, 21 nt, synthetic construct
  misc_feature 1..21: note = RNAi agent antisense strand underlying base sequence
  source 1..21: mol_type = other RNA
tgaatgctgagaaatactccc

SEQ ID NO: 1492 - RNA, 21 nt, synthetic construct
  misc_feature 1..21: note = RNAi agent antisense strand underlying base sequence
  source 1..21: mol_type = other RNA
tcaatgtcatcttctctccgg

SEQ ID NO: 1493 - RNA, 21 nt, synthetic construct
  misc_feature 1..21: note = RNAi agent antisense strand underlying base sequence
  source 1..21: mol_type = other RNA
acaaattccagttatgttacc

SEQ ID NO: 1494 - RNA, 21 nt, synthetic construct
  misc_feature 1..21: note = RNAi agent antisense strand underlying base sequence
  source 1..21: mol_type = other RNA
ttcaattgtgataatggctgg

SEQ ID NO: 1495 - RNA, 21 nt, synthetic construct
  misc_feature 1..21: note = RNAi agent antisense strand underlying base sequence
  source 1..21: mol_type = other RNA
aacatttttgcaacaaagctc

SEQ ID NO: 1496 - RNA, 21 nt, synthetic construct
  misc_feature 1..21: note = RNAi agent antisense strand underlying base sequence
  source 1..21: mol_type = other RNA
tcaacatttttgcaacaaagc

SEQ ID NO: 1497 - RNA, 21 nt, synthetic construct
  misc_feature 1..21: note = RNAi agent antisense strand underlying base sequence
  source 1..21: mol_type = other RNA
tttcactcgaaccacaatccg

SEQ ID NO: 1498 - RNA, 21 nt, synthetic construct
  misc_feature 1..21: note = RNAi agent antisense strand underlying base sequence
  source 1..21: mol_type = other RNA
ttccataatactctgagagac

SEQ ID NO: 1499 - RNA, 21 nt, synthetic construct
  misc_feature 1..21: note = RNAi agent antisense strand underlying base sequence
  source 1..21: mol_type = other RNA
ttccataatactctgagaggg

SEQ ID NO: 1500 - RNA, 21 nt, synthetic construct
  misc_feature 1..21: note = RNAi agent antisense strand underlying base sequence
  source 1..21: mol_type = other RNA
ttccataatactctgagaggc

SEQ ID NO: 1501 - RNA, 21 nt, synthetic construct
  misc_feature 1..21: note = RNAi agent antisense strand underlying base sequence
  source 1..21: mol_type = other RNA
ttccataatactctgagaggt

SEQ ID NO: 1502 - RNA, 21 nt, synthetic construct
  misc_feature 1..21: note = RNAi agent antisense strand underlying base sequence
  source 1..21: mol_type = other RNA
ttccataatactctgagagga

SEQ ID NO: 1503 - RNA, 21 nt, synthetic construct
  misc_feature 1..21: note = RNAi agent antisense strand underlying base sequence
  source 1..21: mol_type = other RNA
ttgacaatatctgtgcggagg

SEQ ID NO: 1504 - RNA, 20 nt, synthetic construct
  misc_feature 1..20: note = RNAi agent antisense strand underlying base sequence
  source 1..20: mol_type = other RNA
atgacaatatctgtgcggag

SEQ ID NO: 1505 - RNA, 19 nt, synthetic construct
  misc_feature 1..19: note = RNAi agent antisense strand underlying base sequence
  source 1..19: mol_type = other RNA
atgacaatatctgtgcgga

SEQ ID NO: 1506 - RNA, 21 nt, synthetic construct
  misc_feature 1..21: note = RNAi agent sense strand underlying base sequence
  source 1..21: mol_type = other RNA
gagattgagaatgccttccaa

SEQ ID NO: 1507 - RNA, 21 nt, synthetic construct
  misc_feature 1..21: note = RNAi agent sense strand underlying base sequence
  source 1..21: mol_type = other RNA
cctcagcttcttcttcaagtt

SEQ ID NO: 1508 - RNA, 21 nt, synthetic construct
  misc_feature 1..21: note = RNAi agent sense strand underlying base sequence
  source 1..21: mol_type = other RNA
gcagcttcttcttcaagttct

SEQ ID NO: 1509 - RNA, 21 nt, synthetic construct
  misc_feature 1..21: note = RNAi agent sense strand underlying base sequence
  source 1..21: mol_type = other RNA
gcttcttcttcaagttctaca

SEQ ID NO: 1510 - RNA, 21 nt, synthetic construct
  misc_feature 1..21: note = RNAi agent sense strand underlying base sequence
  source 1..21: mol_type = other RNA
aggggtgaaaatcacctatga

SEQ ID NO: 1511 - RNA, 21 nt, synthetic construct
  misc_feature 1..21: note = RNAi agent sense strand underlying base sequence
  source 1..21: mol_type = other RNA
gggtgaaaatcacctatgaaa

SEQ ID NO: 1512 - RNA, 21 nt, synthetic construct
  misc_feature 1..21: note = RNAi agent sense strand underlying base sequence
  source 1..21: mol_type = other RNA
ggtgaaaatcacctatgaaga

SEQ ID NO: 1513 - RNA, 21 nt, synthetic construct
  misc_feature 1..21: note = RNAi agent sense strand underlying base sequence
  source 1..21: mol_type = other RNA
gtgaaaatcacctatgaagaa

SEQ ID NO: 1514 - RNA, 21 nt, synthetic construct
  misc_feature 1..21: note = RNAi agent sense strand underlying base sequence
  source 1..21: mol_type = other RNA
ctaccagccattatcacaatt

SEQ ID NO: 1515 - RNA, 21 nt, synthetic construct
  misc_feature 1..21: note = RNAi agent sense strand underlying base sequence
  source 1..21: mol_type = other RNA
gaagaacaactccttttatga

SEQ ID NO: 1516 - RNA, 21 nt, synthetic construct
  misc_feature 1..21: note = RNAi agent sense strand underlying base sequence
  source 1..21: mol_type = other RNA
gagaacaactccttttatgga

SEQ ID NO: 1517 - RNA, 21 nt, synthetic construct
  misc_feature 1..21: note = RNAi agent sense strand underlying base sequence
  source 1..21: mol_type = other RNA
gagacaagcactaacactgta

SEQ ID NO: 1518 - RNA, 21 nt, synthetic construct
  misc_feature 1..21: note = RNAi agent sense strand underlying base sequence
  source 1..21: mol_type = other RNA
tcgtcatgagtatgtacacaa

SEQ ID NO: 1519 - RNA, 21 nt, synthetic construct
  misc_feature 1..21: note = RNAi agent sense strand underlying base sequence
  modified_base 19: mod_base = i
  source 1..21: mol_type = other RNA
aggacatgctgataactgnta

SEQ ID NO: 1520 - RNA, 21 nt, synthetic construct
  misc_feature 1..21: note = RNAi agent sense strand underlying base sequence
  source 1..21: mol_type = other RNA
ggatacaaggttggcttcata

SEQ ID NO: 1521 - RNA, 21 nt, synthetic construct
  misc_feature 1..21: note = RNAi agent sense strand underlying base sequence
  source 1..21: mol_type = other RNA
gcaaggttggcttcatgaaga

SEQ ID NO: 1522 - RNA, 21 nt, synthetic construct
  misc_feature 1..21: note = RNAi agent sense strand underlying base sequence
  source 1..21: mol_type = other RNA
caaggttggcttcatgaagaa

SEQ ID NO: 1523 - RNA, 21 nt, synthetic construct
  misc_feature 1..21: note = RNAi agent sense strand underlying base sequence
  source 1..21: mol_type = other RNA
aggttggcttcatgaagacta

SEQ ID NO: 1524 - RNA, 21 nt, synthetic construct
  misc_feature 1..21: note = RNAi agent sense strand underlying base sequence
  source 1..21: mol_type = other RNA
aggagaattgttggaaaaaga

SEQ ID NO: 1525 - RNA, 21 nt, synthetic construct
  misc_feature 1..21: note = RNAi agent sense strand underlying base sequence
  source 1..21: mol_type = other RNA
gtggcttgctctgaagtagaa

SEQ ID NO: 1526 - RNA, 21 nt, synthetic construct
  misc_feature 1..21: note = RNAi agent sense strand underlying base sequence
  source 1..21: mol_type = other RNA
gcttgctctgaagtagaaata

SEQ ID NO: 1527 - RNA, 21 nt, synthetic construct
  misc_feature 1..21: note = RNAi agent sense strand underlying base sequence
  modified_base 17: mod_base = i
  source 1..21: mol_type = other RNA
ccctgccattgatattngaca

SEQ ID NO: 1528 - RNA, 21 nt, synthetic construct
  misc_feature 1..21: note = RNAi agent sense strand underlying base sequence
  source 1..21: mol_type = other RNA
caagatcgtccacttttctga

SEQ ID NO: 1529 - RNA, 21 nt, synthetic construct
  misc_feature 1..21: note = RNAi agent sense strand underlying base sequence
  source 1..21: mol_type = other RNA
gtccgaagcagataatgttgt

SEQ ID NO: 1530 - RNA, 21 nt, synthetic construct
  misc_feature 1..21: note = RNAi agent sense strand underlying base sequence
  source 1..21: mol_type = other RNA
gtctctctcagagtattatga

SEQ ID NO: 1531 - RNA, 21 nt, synthetic construct
  misc_feature 1..21: note = RNAi agent sense strand underlying base sequence
  source 1..21: mol_type = other RNA
cccaccaagtttggaataaga

SEQ ID NO: 1532 - RNA, 21 nt, synthetic construct
  misc_feature 1..21: note = RNAi agent sense strand underlying base sequence
  source 1..21: mol_type = other RNA
ctgcataaagcaagattacta

SEQ ID NO: 1533 - RNA, 21 nt, synthetic construct
  misc_feature 1..21: note = RNAi agent sense strand underlying base sequence
  source 1..21: mol_type = other RNA
gacaatgttctagatttcttt

SEQ ID NO: 1534 - RNA, 21 nt, synthetic construct
  misc_feature 1..21: note = RNAi agent sense strand underlying base sequence
  source 1..21: mol_type = other RNA
gaaaatgttctagatttcttt

SEQ ID NO: 1535 - RNA, 21 nt, synthetic construct
  misc_feature 1..21: note = RNAi agent sense strand underlying base sequence
  source 1..21: mol_type = other RNA
agtgctggatgagtgaagtta

SEQ ID NO: 1536 - RNA, 21 nt, synthetic construct
  misc_feature 1..21: note = RNAi agent sense strand underlying base sequence
  modified_base 6: mod_base = i
  source 1..21: mol_type = other RNA
gtgctngatgagtgaagttga

SEQ ID NO: 1537 - RNA, 21 nt, synthetic construct
  misc_feature 1..21: note = RNAi agent sense strand underlying base sequence
  modified_base 19: mod_base = i
  source 1..21: mol_type = other RNA
tgctggatgagtgaagttnca

SEQ ID NO: 1538 - RNA, 21 nt, synthetic construct
  misc_feature 1..21: note = RNAi agent sense strand underlying base sequence
  source 1..21: mol_type = other RNA
gatgctctccaagtatgatca

SEQ ID NO: 1539 - RNA, 21 nt, synthetic construct
  misc_feature 1..21: note = RNAi agent sense strand underlying base sequence
  source 1..21: mol_type = other RNA
gtgatcgtctgcagaacaaga

SEQ ID NO: 1540 - RNA, 21 nt, synthetic construct
  misc_feature 1..21: note = RNAi agent sense strand underlying base sequence
  source 1..21: mol_type = other RNA
gtcgtctgcagaacaagatca

SEQ ID NO: 1541 - RNA, 21 nt, synthetic construct
  misc_feature 1..21: note = RNAi agent sense strand underlying base sequence
  source 1..21: mol_type = other RNA
gtcgccagtgcaactttacta

SEQ ID NO: 1542 - RNA, 21 nt, synthetic construct
  misc_feature 1..21: note = RNAi agent sense strand underlying base sequence
  source 1..21: mol_type = other RNA
aggataaggttacttgtgtta

SEQ ID NO: 1543 - RNA, 21 nt, synthetic construct
  misc_feature 1..21: note = RNAi agent sense strand underlying base sequence
  source 1..21: mol_type = other RNA
accagccattatcacaattga

SEQ ID NO: 1544 - RNA, 21 nt, synthetic construct
  misc_feature 1..21: note = RNAi agent sense strand underlying base sequence
  source 1..21: mol_type = other RNA
caagctctcagtatcatgcta

SEQ ID NO: 1545 - RNA, 21 nt, synthetic construct
  misc_feature 1..21: note = RNAi agent sense strand underlying base sequence
  source 1..21: mol_type = other RNA
gaagagtgaggttgacaagtt

SEQ ID NO: 1546 - RNA, 21 nt, synthetic construct
  misc_feature 1..21: note = RNAi agent sense strand underlying base sequence
  source 1..21: mol_type = other RNA
gagagtgaggttgacaagtta

SEQ ID NO: 1547 - RNA, 21 nt, synthetic construct
  misc_feature 1..21: note = RNAi agent sense strand underlying base sequence
  source 1..21: mol_type = other RNA
gttcaacaaggagaattgtta

SEQ ID NO: 1548 - RNA, 21 nt, synthetic construct
  misc_feature 1..21: note = RNAi agent sense strand underlying base sequence
  source 1..21: mol_type = other RNA
ggaacataccacagaacatga

SEQ ID NO: 1549 - RNA, 21 nt, synthetic construct
  misc_feature 1..21: note = RNAi agent sense strand underlying base sequence
  source 1..21: mol_type = other RNA
gaacatggatctattaaagta

SEQ ID NO: 1550 - RNA, 21 nt, synthetic construct
  misc_feature 1..21: note = RNAi agent sense strand underlying base sequence
  source 1..21: mol_type = other RNA
gacatggatctattaaagtca

SEQ ID NO: 1551 - RNA, 21 nt, synthetic construct
  misc_feature 1..21: note = RNAi agent sense strand underlying base sequence
  source 1..21: mol_type = other RNA
tgcctaaatggtgaatatgca

SEQ ID NO: 1552 - RNA, 21 nt, synthetic construct
  misc_feature 1..21: note = RNAi agent sense strand underlying base sequence
  source 1..21: mol_type = other RNA
gaacctctagaagcttaaaca

SEQ ID NO: 1553 - RNA, 21 nt, synthetic construct
  misc_feature 1..21: note = RNAi agent sense strand underlying base sequence
  source 1..21: mol_type = other RNA
ggccttcaaaccaatgaacaa

SEQ ID NO: 1554 - RNA, 21 nt, synthetic construct
  misc_feature 1..21: note = RNAi agent sense strand underlying base sequence
  source 1..21: mol_type = other RNA
ccaatgaacagcaaagcataa

SEQ ID NO: 1555 - RNA, 21 nt, synthetic construct
  misc_feature 1..21: note = RNAi agent sense strand underlying base sequence
  source 1..21: mol_type = other RNA
gatgaacagcaaagcataaca

SEQ ID NO: 1556 - RNA, 21 nt, synthetic construct
  misc_feature 1..21: note = RNAi agent sense strand underlying base sequence
  source 1..21: mol_type = other RNA
gtgaacagcaaagcataacct

SEQ ID NO: 1557 - RNA, 21 nt, synthetic construct
  misc_feature 1..21: note = RNAi agent sense strand underlying base sequence
  source 1..21: mol_type = other RNA
gaacagcaaagcataacctta

SEQ ID NO: 1558 - RNA, 21 nt, synthetic construct
  misc_feature 1..21: note = RNAi agent sense strand underlying base sequence
  source 1..21: mol_type = other RNA
gcaaagcataaccttgaatct

SEQ ID NO: 1559 - RNA, 21 nt, synthetic construct
  misc_feature 1..21: note = RNAi agent sense strand underlying base sequence
  source 1..21: mol_type = other RNA
ccaaccaactcaattattgaa

SEQ ID NO: 1560 - RNA, 21 nt, synthetic construct
  misc_feature 1..21: note = RNAi agent sense strand underlying base sequence
  source 1..21: mol_type = other RNA
cttcctgtgatccattttact

SEQ ID NO: 1561 - RNA, 21 nt, synthetic construct
  misc_feature 1..21: note = RNAi agent sense strand underlying base sequence
  source 1..21: mol_type = other RNA
ggttttcttactgtcatatga

SEQ ID NO: 1562 - RNA, 21 nt, synthetic construct
  misc_feature 1..21: note = RNAi agent sense strand underlying base sequence
  source 1..21: mol_type = other RNA
gagatcgagaatgccttccaa

SEQ ID NO: 1563 - RNA, 21 nt, synthetic construct
  misc_feature 1..21: note = RNAi agent sense strand underlying base sequence
  source 1..21: mol_type = other RNA
gactggcattttcaatgatga

SEQ ID NO: 1564 - RNA, 21 nt, synthetic construct
  misc_feature 1..21: note = RNAi agent sense strand underlying base sequence
  source 1..21: mol_type = other RNA
gtcaatgatgaaactgtcttt

SEQ ID NO: 1565 - RNA, 21 nt, synthetic construct
  misc_feature 1..21: note = RNAi agent sense strand underlying base sequence
  source 1..21: mol_type = other RNA
gaggatgaggttacttgtgtt

SEQ ID NO: 1566 - RNA, 21 nt, synthetic construct
  misc_feature 1..21: note = RNAi agent sense strand underlying base sequence
  source 1..21: mol_type = other RNA
ctgaagctgacaatgttgtct

SEQ ID NO: 1567 - RNA, 21 nt, synthetic construct
  misc_feature 1..21: note = RNAi agent sense strand underlying base sequence
  source 1..21: mol_type = other RNA
gctttattgcaaagatgttga

SEQ ID NO: 1568 - RNA, 21 nt, synthetic construct
  misc_feature 1..21: note = RNAi agent sense strand underlying base sequence
  source 1..21: mol_type = other RNA
gaggatttgtaagactaatct

SEQ ID NO: 1569 - RNA, 21 nt, synthetic construct
  misc_feature 1..21: note = RNAi agent sense strand underlying base sequence
  source 1..21: mol_type = other RNA
ccgactaagtttggaataaga

SEQ ID NO: 1570 - RNA, 21 nt, synthetic construct
  misc_feature 1..21: note = RNAi agent sense strand underlying base sequence
  source 1..21: mol_type = other RNA
gcttcacactttcttttctga

SEQ ID NO: 1571 - RNA, 21 nt, synthetic construct
  misc_feature 1..21: note = RNAi agent sense strand underlying base sequence
  source 1..21: mol_type = other RNA
gcagctttgagacaaactcta

SEQ ID NO: 1572 - RNA, 21 nt, synthetic construct
  misc_feature 1..21: note = RNAi agent sense strand underlying base sequence
  source 1..21: mol_type = other RNA
gagaaattgactgcttaacaa

SEQ ID NO: 1573 - RNA, 21 nt, synthetic construct
  misc_feature 1..21: note = RNAi agent sense strand underlying base sequence
  source 1..21: mol_type = other RNA
ccgtagtatccagatttccaa

SEQ ID NO: 1574 - RNA, 21 nt, synthetic construct
  misc_feature 1..21: note = RNAi agent sense strand underlying base sequence
  source 1..21: mol_type = other RNA
agcaggatggcattttcaaga

SEQ ID NO: 1575 - RNA, 21 nt, synthetic construct
  misc_feature 1..21: note = RNAi agent sense strand underlying base sequence
  source 1..21: mol_type = other RNA
gacaattgtgatccaaatcat

SEQ ID NO: 1576 - RNA, 21 nt, synthetic construct
  misc_feature 1..21: note = RNAi agent sense strand underlying base sequence
  source 1..21: mol_type = other RNA
tggcagttttgagtaattcta

SEQ ID NO: 1577 - RNA, 21 nt, synthetic construct
  misc_feature 1..21: note = RNAi agent sense strand underlying base sequence
  source 1..21: mol_type = other RNA
gtctgagtccatttttgatca

SEQ ID NO: 1578 - RNA, 21 nt, synthetic construct
  misc_feature 1..21: note = RNAi agent sense strand underlying base sequence
  source 1..21: mol_type = other RNA
ctagatctgcatgctttctta

SEQ ID NO: 1579 - RNA, 21 nt, synthetic construct
  misc_feature 1..21: note = RNAi agent sense strand underlying base sequence
  source 1..21: mol_type = other RNA
cttcagagagcttatatctga

SEQ ID NO: 1580 - RNA, 21 nt, synthetic construct
  misc_feature 1..21: note = RNAi agent sense strand underlying base sequence
  modified_base 14: mod_base = i
  source 1..21: mol_type = other RNA
ggatacaaggttgncttcata

SEQ ID NO: 1581 - RNA, 21 nt, synthetic construct
  misc_feature 1..21: note = RNAi agent sense strand underlying base sequence
  modified_base 13: mod_base = i
  source 1..21: mol_type = other RNA
ggatacaaggttngcttcata

SEQ ID NO: 1582 - RNA, 21 nt, synthetic construct
  misc_feature 1..21: note = RNAi agent sense strand underlying base sequence
  source 1..21: mol_type = other RNA
ggatacaaggttggtttcata

SEQ ID NO: 1583 - RNA, 21 nt, synthetic construct
  misc_feature 1..21: note = RNAi agent sense strand underlying base sequence
  modified_base 16: mod_base = i
  source 1..21: mol_type = other RNA
gtggagaaaaatgcanatcca

SEQ ID NO: 1584 - RNA, 21 nt, synthetic construct
  misc_feature 1..21: note = RNAi agent sense strand underlying base sequence
  source 1..21: mol_type = other RNA
tccagagacaactcttttgga

SEQ ID NO: 1585 - RNA, 21 nt, synthetic construct
  misc_feature 1..21: note = RNAi agent sense strand underlying base sequence
  modified_base 17: mod_base = i
  source 1..21: mol_type = other RNA
ctctccaagtatgatcntcta

SEQ ID NO: 1586 - RNA, 21 nt, synthetic construct
  misc_feature 1..21: note = RNAi agent sense strand underlying base sequence
  source 1..21: mol_type = other RNA
gcaactgtggaaggaatagga

SEQ ID NO: 1587 - RNA, 21 nt, synthetic construct
  misc_feature 1..21: note = RNAi agent sense strand underlying base sequence
  source 1..21: mol_type = other RNA
tggcatcgtcatgagtatgta

SEQ ID NO: 1588 - RNA, 21 nt, synthetic construct
  misc_feature 1..21: note = RNAi agent sense strand underlying base sequence
  modified_base 20: mod_base = i
  source 1..21: mol_type = other RNA
gccttccaaggaaatctgtna

SEQ ID NO: 1589 - RNA, 21 nt, synthetic construct
  misc_feature 1..21: note = RNAi agent sense strand underlying base sequence
  source 1..21: mol_type = other RNA
gtggcattgagatgaagttca

SEQ ID NO: 1590 - RNA, 21 nt, synthetic construct
  misc_feature 1..21: note = RNAi agent sense strand underlying base sequence
  modified_base 2: mod_base = OTHER; note = 2-aminoadenine
  source 1..21: mol_type = other RNA
gntgaagttcaagaatatgct

SEQ ID NO: 1591 - RNA, 21 nt, synthetic construct
  misc_feature 1..21: note = RNAi agent sense strand underlying base sequence
  source 1..21: mol_type = other RNA
ggaatatgctgtttcctatga

SEQ ID NO: 1592 - RNA, 21 nt, synthetic construct
  misc_feature 1..21: note = RNAi agent sense strand underlying base sequence
  modified_base 16: mod_base = i
  source 1..21: mol_type = other RNA
gctgctctccataganatcca

SEQ ID NO: 1593 - RNA, 21 nt, synthetic construct
  misc_feature 1..21: note = RNAi agent sense strand underlying base sequence
  source 1..21: mol_type = other RNA
gagtatttctcagcattcaaa

SEQ ID NO: 1594 - RNA, 21 nt, synthetic construct
  misc_feature 1..21: note = RNAi agent sense strand underlying base sequence
  source 1..21: mol_type = other RNA
cgccaagatcaagtccataga

SEQ ID NO: 1595 - RNA, 21 nt, synthetic construct
  misc_feature 1..21: note = RNAi agent sense strand underlying base sequence
  source 1..21: mol_type = other RNA
tccagggtttgtttgtttcat

SEQ ID NO: 1596 - RNA, 21 nt, synthetic construct
  misc_feature 1..21: note = RNAi agent sense strand underlying base sequence
  source 1..21: mol_type = other RNA
gtcacctatgaagaactacca

SEQ ID NO: 1597 - RNA, 21 nt, synthetic construct
  misc_feature 1..21: note = RNAi agent sense strand underlying base sequence
  source 1..21: mol_type = other RNA
gagaactaccagccattatca

SEQ ID NO: 1598 - RNA, 21 nt, synthetic construct
  misc_feature 1..21: note = RNAi agent sense strand underlying base sequence
  source 1..21: mol_type = other RNA
cagccattatcacaattgaga

SEQ ID NO: 1599 - RNA, 21 nt, synthetic construct
  misc_feature 1..21: note = RNAi agent sense strand underlying base sequence
  source 1..21: mol_type = other RNA
tgagctgaagatcgagaaaga

SEQ ID NO: 1600 - RNA, 21 nt, synthetic construct
  misc_feature 1..21: note = RNAi agent sense strand underlying base sequence
  source 1..21: mol_type = other RNA
ctgcaccattgctgttccaaa

SEQ ID NO: 1601 - RNA, 21 nt, synthetic construct
  misc_feature 1..21: note = RNAi agent sense strand underlying base sequence
  source 1..21: mol_type = other RNA
gtggagctctttgtgtttaca

SEQ ID NO: 1602 - RNA, 21 nt, synthetic construct
  misc_feature 1..21: note = RNAi agent sense strand underlying base sequence
  modified_base 20: mod_base = i
  source 1..21: mol_type = other RNA
agctctttgtgtctacacana

SEQ ID NO: 1603 - RNA, 21 nt, synthetic construct
  misc_feature 1..21: note = RNAi agent sense strand underlying base sequence
  source 1..21: mol_type = other RNA
ctctctcagagtattatggaa

SEQ ID NO: 1604 - RNA, 21 nt, synthetic construct
  misc_feature 1..21: note = RNAi agent sense strand underlying base sequence
  modified_base 20: mod_base = i
  source 1..21: mol_type = other RNA
gcagagtattatggaacgana

SEQ ID NO: 1605 - RNA, 21 nt, synthetic construct
  misc_feature 1..21: note = RNAi agent sense strand underlying base sequence
  source 1..21: mol_type = other RNA
tccagggtttgtttgtttcaa

SEQ ID NO: 1606 - RNA, 21 nt, synthetic construct
  misc_feature 1..21: note = RNAi agent sense strand underlying base sequence
  source 1..21: mol_type = other RNA
ccagggtttgtttgtttcatt

SEQ ID NO: 1607 - RNA, 21 nt, synthetic construct
  misc_feature 1..21: note = RNAi agent sense strand underlying base sequence
  source 1..21: mol_type = other RNA
cagggtttgtttgtttcattt

SEQ ID NO: 1608 - RNA, 21 nt, synthetic construct
  misc_feature 1..21: note = RNAi agent sense strand underlying base sequence
  source 1..21: mol_type = other RNA
gggtttgtttgtttcatttca

SEQ ID NO: 1609 - RNA, 21 nt, synthetic construct
  misc_feature 1..21: note = RNAi agent sense strand underlying base sequence
  modified_base 18: mod_base = i
  source 1..21: mol_type = other RNA
gctctccaagtatgatcntct

SEQ ID NO: 1610 - RNA, 21 nt, synthetic construct
  misc_feature 1..21: note = RNAi agent sense strand underlying base sequence
  modified_base 17: mod_base = i
  source 1..21: mol_type = other RNA
ggaggagattgagaatncctt

SEQ ID NO: 1611 - RNA, 21 nt, synthetic construct
  misc_feature 1..21: note = RNAi agent sense strand underlying base sequence
  source 1..21: mol_type = other RNA
cgagaatgccttccaaggaaa

SEQ ID NO: 1612 - RNA, 21 nt, synthetic construct
  misc_feature 1..21: note = RNAi agent sense strand underlying base sequence
  source 1..21: mol_type = other RNA
gatgccttccaaggaaatcta

SEQ ID NO: 1613 - RNA, 21 nt, synthetic construct
  misc_feature 1..21: note = RNAi agent sense strand underlying base sequence
  modified_base 2: mod_base = OTHER; note = 2-aminoadenine
  source 1..21: mol_type = other RNA
cnagaatatgctgtttcctat

SEQ ID NO: 1614 - RNA, 21 nt, synthetic construct
  misc_feature 1..21: note = RNAi agent sense strand underlying base sequence
  source 1..21: mol_type = other RNA
cgttggagggaacatcatcaa

SEQ ID NO: 1615 - RNA, 21 nt, synthetic construct
  misc_feature 1..21: note = RNAi agent sense strand underlying base sequence
  source 1..21: mol_type = other RNA
cagcttcttcttcaagttcta

SEQ ID NO: 1616 - RNA, 21 nt, synthetic construct
  misc_feature 1..21: note = RNAi agent sense strand underlying base sequence
  source 1..21: mol_type = other RNA
gtgttgggcatatcattggta

SEQ ID NO: 1617 - RNA, 21 nt, synthetic construct
  misc_feature 1..21: note = RNAi agent sense strand underlying base sequence
  source 1..21: mol_type = other RNA
cgtctacacagaacaccatga

SEQ ID NO: 1618 - RNA, 21 nt, synthetic construct
  misc_feature 1..21: note = RNAi agent sense strand underlying base sequence
  source 1..21: mol_type = other RNA
gacacccaggatctctttcaa

SEQ ID NO: 1619 - RNA, 21 nt, synthetic construct
  misc_feature 1..21: note = RNAi agent sense strand underlying base sequence
  source 1..21: mol_type = other RNA
agcaagctctcagtatcatga

SEQ ID NO: 1620 - RNA, 21 nt, synthetic construct
  misc_feature 1..21: note = RNAi agent sense strand underlying base sequence
  source 1..21: mol_type = other RNA
tcggaagagtgaggttgacaa

SEQ ID NO: 1621 - RNA, 21 nt, synthetic construct
  misc_feature 1..21: note = RNAi agent sense strand underlying base sequence
  source 1..21: mol_type = other RNA
gacaaggagaattgttggaaa

SEQ ID NO: 1622 - RNA, 21 nt, synthetic construct
  misc_feature 1..21: note = RNAi agent sense strand underlying base sequence
  source 1..21: mol_type = other RNA
gcagctttgagactaactcaa

SEQ ID NO: 1623 - RNA, 21 nt, synthetic construct
  misc_feature 1..21: note = RNAi agent sense strand underlying base sequence
  source 1..21: mol_type = other RNA
cctccgcacagatattgtcat

SEQ ID NO: 1624 - RNA, 21 nt, synthetic construct
  misc_feature 1..21: note = RNAi agent sense strand underlying base sequence
  source 1..21: mol_type = other RNA
tccgcacagatattgtcatga

SEQ ID NO: 1625 - RNA, 21 nt, synthetic construct
  misc_feature 1..21: note = RNAi agent sense strand underlying base sequence
  source 1..21: mol_type = other RNA
ggctgcttctatcttctttga

SEQ ID NO: 1626 - RNA, 21 nt, synthetic construct
  misc_feature 1..21: note = RNAi agent sense strand underlying base sequence
  modified_base 20: mod_base = i
  source 1..21: mol_type = other RNA
agcacacaggtaataacgtna

SEQ ID NO: 1627 - RNA, 21 nt, synthetic construct
  misc_feature 1..21: note = RNAi agent sense strand underlying base sequence
  source 1..21: mol_type = other RNA
cctgtataacctcaagttcta

SEQ ID NO: 1628 - RNA, 21 nt, synthetic construct
  misc_feature 1..21: note = RNAi agent sense strand underlying base sequence
  source 1..21: mol_type = other RNA
gaccaatgaacagcaaagcat

SEQ ID NO: 1629 - RNA, 21 nt, synthetic construct
  misc_feature 1..21: note = RNAi agent sense strand underlying base sequence
  modified_base 2: mod_base = OTHER; note = 2-aminoadenine
  source 1..21: mol_type = other RNA
cntaaccttgaatctatacta

SEQ ID NO: 1630 - RNA, 21 nt, synthetic construct
  misc_feature 1..21: note = RNAi agent sense strand underlying base sequence
  source 1..21: mol_type = other RNA
ggcataaagcaagattactct

SEQ ID NO: 1631 - RNA, 21 nt, synthetic construct
  misc_feature 1..21: note = RNAi agent sense strand underlying base sequence
  source 1..21: mol_type = other RNA
tccacctagaaatgatgctat

SEQ ID NO: 1632 - RNA, 21 nt, synthetic construct
  misc_feature 1..21: note = RNAi agent sense strand underlying base sequence
  modified_base 18: mod_base = i
  source 1..21: mol_type = other RNA
ctagctctgtctcttctntct

SEQ ID NO: 1633 - RNA, 21 nt, synthetic construct
  misc_feature 1..21: note = RNAi agent sense strand underlying base sequence
  modified_base 3: mod_base = OTHER; note = 2-aminoadenine
  source 1..21: mol_type = other RNA
ctnaggcttggttttcttact

SEQ ID NO: 1634 - RNA, 21 nt, synthetic construct
  misc_feature 1..21: note = RNAi agent sense strand underlying base sequence
  source 1..21: mol_type = other RNA
cagtgatgctctccaagtata

SEQ ID NO: 1635 - RNA, 21 nt, synthetic construct
  misc_feature 1..21: note = RNAi agent sense strand underlying base sequence
  modified_base 18: mod_base = i
  source 1..21: mol_type = other RNA
gccaagtatgatcgtctncaa

SEQ ID NO: 1636 - RNA, 21 nt, synthetic construct
  misc_feature 1..21: note = RNAi agent sense strand underlying base sequence
  source 1..21: mol_type = other RNA
tggcatgagagttttattcaa

SEQ ID NO: 1637 - RNA, 21 nt, synthetic construct
  misc_feature 1..21: note = RNAi agent sense strand underlying base sequence
  modified_base 16: mod_base = OTHER; note = 2-aminoadenine
  source 1..21: mol_type = other RNA
tggcatgagagttttnttcaa

SEQ ID NO: 1638 - RNA, 21 nt, synthetic construct
  misc_feature 1..21: note = RNAi agent sense strand underlying base sequence
  source 1..21: mol_type = other RNA
cctcagcttcttcttcaagta

SEQ ID NO: 1639 - RNA, 21 nt, synthetic construct
  misc_feature 1..21: note = RNAi agent sense strand underlying base sequence
  source 1..21: mol_type = other RNA
cctcagcttcttctttaagta

SEQ ID NO: 1640 - RNA, 21 nt, synthetic construct
  misc_feature 1..21: note = RNAi agent sense strand underlying base sequence
  source 1..21: mol_type = other RNA
gacaagatcgtccacttttct

SEQ ID NO: 1641 - RNA, 21 nt, synthetic construct
  misc_feature 1..21: note = RNAi agent sense strand underlying base sequence
  source 1..21: mol_type = other RNA
accatgttgcagtgacaacta

SEQ ID NO: 1642 - RNA, 21 nt, synthetic construct
  misc_feature 1..21: note = RNAi agent sense strand underlying base sequence
  source 1..21: mol_type = other RNA
ggtgacaactgtggaaggaat

SEQ ID NO: 1643 - RNA, 21 nt, synthetic construct
  misc_feature 1..21: note = RNAi agent sense strand underlying base sequence
  source 1..21: mol_type = other RNA
gtggaggagattgagaatgca

SEQ ID NO: 1644 - RNA, 21 nt, synthetic construct
  misc_feature 1..21: note = RNAi agent sense strand underlying base sequence
  source 1..21: mol_type = other RNA
gacacggagattggcattgaa

SEQ ID NO: 1645 - RNA, 21 nt, synthetic construct
  misc_feature 1..21: note = RNAi agent sense strand underlying base sequence
  modified_base 20: mod_base = OTHER; note = 2-aminoadenine
  source 1..21: mol_type = other RNA
cgagatgaagttcaagaatnt

SEQ ID NO: 1646 - RNA, 21 nt, synthetic construct
  misc_feature 1..21: note = RNAi agent sense strand underlying base sequence
  source 1..21: mol_type = other RNA
aggagatactgctctccataa

SEQ ID NO: 1647 - RNA, 21 nt, synthetic construct
  misc_feature 1..21: note = RNAi agent sense strand underlying base sequence
  source 1..21: mol_type = other RNA
ggggagtatttctcagcatta

SEQ ID NO: 1648 - RNA, 21 nt, synthetic construct
  misc_feature 1..21: note = RNAi agent sense strand underlying base sequence
  source 1..21: mol_type = other RNA
gggagtatttctcagcattca

SEQ ID NO: 1649 - RNA, 21 nt, synthetic construct
  misc_feature 1..21: note = RNAi agent sense strand underlying base sequence
  source 1..21: mol_type = other RNA
ccggagagaagatgacattga

SEQ ID NO: 1650 - RNA, 21 nt, synthetic construct
  misc_feature 1..21: note = RNAi agent sense strand underlying base sequence
  source 1..21: mol_type = other RNA
ggtaacataactggaatttgt

SEQ ID NO: 1651 - RNA, 21 nt, synthetic construct
  misc_feature 1..21: note = RNAi agent sense strand underlying base sequence
  source 1..21: mol_type = other RNA
ccagccattatcacaattgaa

SEQ ID NO: 1652 - RNA, 21 nt, synthetic construct
  misc_feature 1..21: note = RNAi agent sense strand underlying base sequence
  source 1..21: mol_type = other RNA
gagctttgttgcaaaaatgtt

SEQ ID NO: 1653 - RNA, 21 nt, synthetic construct
  misc_feature 1..21: note = RNAi agent sense strand underlying base sequence
  source 1..21: mol_type = other RNA
gctttgttgcaaaaatgttga

SEQ ID NO: 1654 - RNA, 21 nt, synthetic construct
  misc_feature 1..21: note = RNAi agent sense strand underlying base sequence
  source 1..21: mol_type = other RNA
cggattgtggttcgagtgaaa

SEQ ID NO: 1655 - RNA, 21 nt, synthetic construct
  misc_feature 1..21: note = RNAi agent sense strand underlying base sequence
  source 1..21: mol_type = other RNA
gtctctcagagtattatggaa

SEQ ID NO: 1656 - RNA, 21 nt, synthetic construct
  misc_feature 1..21: note = RNAi agent sense strand underlying base sequence
  source 1..21: mol_type = other RNA
ccctctcagagtattatggaa

SEQ ID NO: 1657 - RNA, 21 nt, synthetic construct
  misc_feature 1..21: note = RNAi agent sense strand underlying base sequence
  source 1..21: mol_type = other RNA
gcctctcagagtattatggaa

SEQ ID NO: 1658 - RNA, 21 nt, synthetic construct
  misc_feature 1..21: note = RNAi agent sense strand underlying base sequence
  source 1..21: mol_type = other RNA
acctctcagagtattatggaa

SEQ ID NO: 1659 - RNA, 21 nt, synthetic construct
  misc_feature 1..21: note = RNAi agent sense strand underlying base sequence
  source 1..21: mol_type = other RNA
tcctctcagagtattatggaa

SEQ ID NO: 1660 - RNA, 21 nt, synthetic construct
  misc_feature 1..21: note = RNAi agent sense strand underlying base sequence
  source 1..21: mol_type = other RNA
cctccgcacagatattgtcaa

SEQ ID NO: 1661 - RNA, 20 nt, synthetic construct
  misc_feature 1..20: note = RNAi agent sense strand underlying base sequence
  source 1..20: mol_type = other RNA
ctccgcacagatattgtcat

SEQ ID NO: 1662 - RNA, 19 nt, synthetic construct
  misc_feature 1..19: note = RNAi agent sense strand underlying base sequence
  source 1..19: mol_type = other RNA
tccgcacagatattgtcat

SEQ ID NO: 1663 - RNA, 21 nt, synthetic construct
  misc_feature 1..21: note = RNAi agent sense strand modified sequence
  source 1..21: mol_type = other RNA
ctctctcagagtattatggaa

SEQ ID NO: 1664 - RNA, 21 nt, synthetic construct
  misc_feature 1..21: note = RNAi agent sense strand modified sequence
  source 1..21: mol_type = other RNA
cctccgcacagatattgtcat

SEQ ID NO: 1665 - RNA, 21 nt, synthetic construct
  misc_feature 1..21: note = RNAi agent sense strand modified sequence
  source 1..21: mol_type = other RNA
tgcctaaatggtgaatatgca

SEQ ID NO: 1666 - RNA, 21 nt, synthetic construct
  misc_feature 1..21: note = RNAi agent sense strand modified sequence
  source 1..21: mol_type = other RNA
tccagggtttgtttgtttcat

SEQ ID NO: 1667 - RNA, 21 nt, synthetic construct
  misc_feature 1..21: note = RNAi agent sense strand modified sequence
  modified_base 18: mod_base = OTHER; note = 2'-O-methylinosine-3'-phosphate
  source 1..21: mol_type = other RNA
gctctccaagtatgatcntct

SEQ ID NO: 1668 - RNA, 21 nt, synthetic construct
  misc_feature 1..21: note = RNAi agent sense strand modified sequence
  source 1..21: mol_type = other RNA
gagtatttctcagcattcaaa

SEQ ID NO: 1669 - RNA, 21 nt, synthetic construct
  misc_feature 1..21: note = RNAi agent sense strand modified sequence
  source 1..21: mol_type = other RNA
gacaaggagaattgttggaaa

SEQ ID NO: 1670 - RNA, 21 nt, synthetic construct
  misc_feature 1..21: note = RNAi agent sense strand modified sequence
  source 1..21: mol_type = other RNA
tcggaagagtgaggttgacaa

SEQ ID NO: 1671 - RNA, 21 nt, synthetic construct
  misc_feature 1..21: note = RNAi agent sense strand modified sequence
  source 1..21: mol_type = other RNA
agcaagctctcagtatcatga

SEQ ID NO: 1672 - RNA, 23 nt, synthetic construct
  misc_feature 1..23: note = RNAi agent antisense strand modified sequence
  source 1..23: mol_type = other RNA
actcgttccataatactctgaga

SEQ ID NO: 1673 - RNA, 23 nt, synthetic construct
  misc_feature 1..23: note = RNAi agent antisense strand modified sequence
  source 1..23: mol_type = other RNA
atccataatactctgagagagat

SEQ ID NO: 1674 - RNA, 23 nt, synthetic construct
  misc_feature 1..23: note = RNAi agent antisense strand underlying base sequence
  source 1..23: mol_type = other RNA
actcgttccataatactctgaga

SEQ ID NO: 1675 - RNA, 23 nt, synthetic construct
  misc_feature 1..23: note = RNAi agent antisense strand underlying base sequence
  source 1..23: mol_type = other RNA
atccataatactctgagagagat

SEQ ID NO: 1676 - RNA, 21 nt, synthetic construct
  misc_feature 1..21: note = RNAi agent sense strand modified sequence
  source 1..21: mol_type = other RNA
tcagagtattatggaacgagt

SEQ ID NO: 1677 - RNA, 21 nt, synthetic construct
  misc_feature 1..21: note = RNAi agent sense strand modified sequence
  source 1..21: mol_type = other RNA
ctctctcagagtattatggat

SEQ ID NO: 1678 - RNA, 21 nt, synthetic construct
  misc_feature 1..21: note = RNAi agent sense strand underlying base sequence
  source 1..21: mol_type = other RNA
tcagagtattatggaacgagt

SEQ ID NO: 1679 - RNA, 21 nt, synthetic construct
  misc_feature 1..21: note = RNAi agent sense strand underlying base sequence
  source 1..21: mol_type = other RNA
ctctctcagagtattatggat

SEQ ID NO: 1680 - RNA, 21 nt, synthetic construct
  misc_feature 1..21: note = RNAi agent sense strand modified sequence
  source 1..21: mol_type = other RNA
ctctctcagagtattatggaa

SEQ ID NO: 1681 - RNA, 21 nt, synthetic construct
  misc_feature 1..21: note = RNAi agent sense strand modified sequence
  source 1..21: mol_type = other RNA
cctccgcacagatattgtcat

SEQ ID NO: 1682 - RNA, 21 nt, synthetic construct
  misc_feature 1..21: note = RNAi agent sense strand modified sequence
  source 1..21: mol_type = other RNA
tgcctaaatggtgaatatgca

SEQ ID NO: 1683 - RNA, 21 nt, synthetic construct
  misc_feature 1..21: note = RNAi agent sense strand modified sequence
  source 1..21: mol_type = other RNA
tccagggtttgtttgtttcat

SEQ ID NO: 1684 - RNA, 21 nt, synthetic construct
  misc_feature 1..21: note = RNAi agent sense strand modified sequence
  modified_base 18: mod_base = OTHER; note = 2'-O-methylinosine-3'-phosphate
  source 1..21: mol_type = other RNA
gctctccaagtatgatcntct

SEQ ID NO: 1685 - RNA, 21 nt, synthetic construct
  misc_feature 1..21: note = RNAi agent sense strand modified sequence
  source 1..21: mol_type = other RNA
gagtatttctcagcattcaaa

SEQ ID NO: 1686 - RNA, 21 nt, synthetic construct
  misc_feature 1..21: note = RNAi agent sense strand modified sequence
  source 1..21: mol_type = other RNA
gacaaggagaattgttggaaa

SEQ ID NO: 1687 - RNA, 21 nt, synthetic construct
  misc_feature 1..21: note = RNAi agent sense strand modified sequence
  source 1..21: mol_type = other RNA
tcggaagagtgaggttgacaa

SEQ ID NO: 1688 - RNA, 21 nt, synthetic construct
  misc_feature 1..21: note = RNAi agent sense strand modified sequence
  source 1..21: mol_type = other RNA
agcaagctctcagtatcatga

What is claimed is:

1. A method of treating an Xanthine Dehydrogenase (XDH)-related disease in a subject in need thereof, wherein the XDH-related disease comprises hyperuricemia or gout, comprising:

providing an RNAi agent comprising a sense strand and an antisense strand, wherein the sense strand comprises

3. The method of claim 2, wherein the inverted abasic residue is coupled to an adjacent nucleoside via a phosphorothioate backbone.

4. The method of claim 1, wherein the 5' end of the sense strand is coupled to a targeting ligand.

5. The method of claim 4, wherein the targeting ligand comprises:

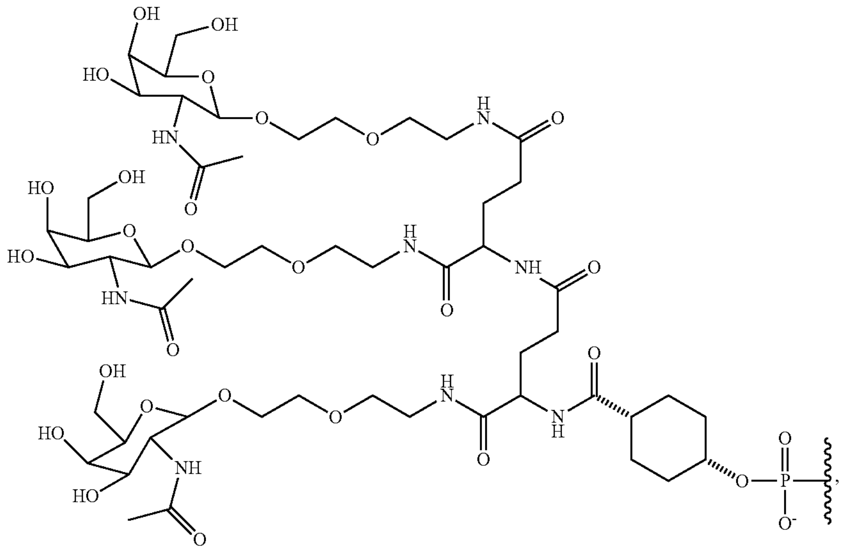

, or

-continued

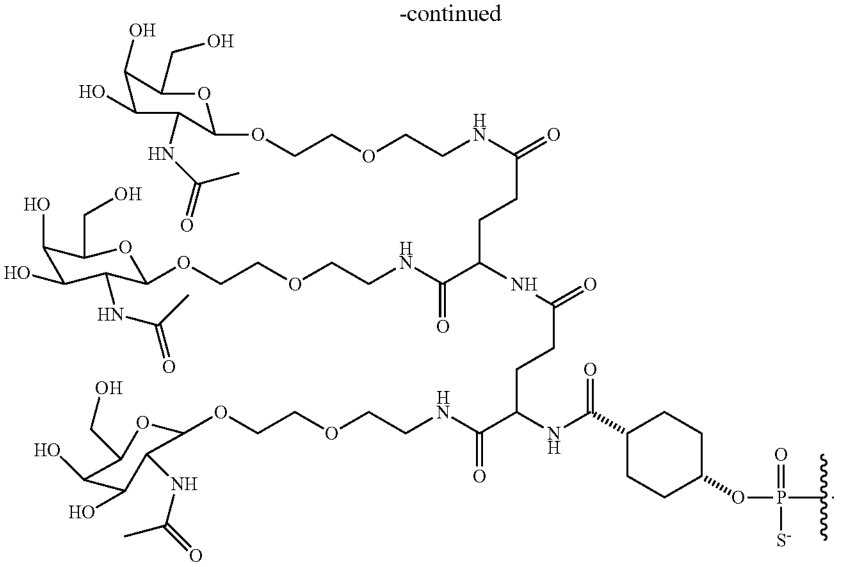

6. The method of claim 4, wherein the targeting ligand is

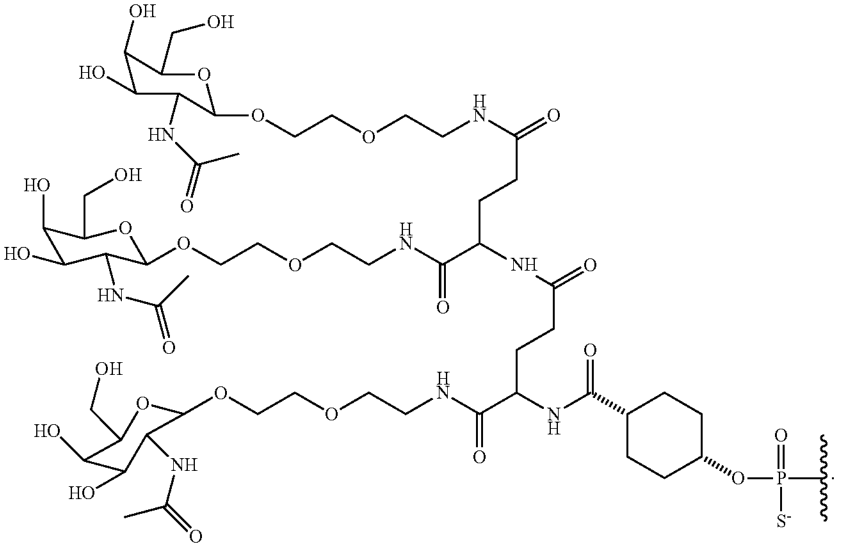

7. The method of claim 1, wherein the RNAi agent is a pharmaceutically acceptable salt.

8. The method of claim 7, wherein the pharmaceutically acceptable salt is a sodium salt.

9. The method of claim 1, wherein the RNAi agent is administered intravenously or subcutaneously.

10. The method of claim 1, wherein the RNAi agent is administered to the subject in an effective amount that reduces XDH gene expression level, XDH mRNA expression level, XDH protein expression level, or XDH activity level in the subject at least about 30% relative to the expression levels of the subject prior to the administration.

11. The method of claim 1, wherein the RNAi agent is administered to the subject in an effective amount that reduces a level of serum uric acid level.

12. The method of claim 1, wherein the RNAi agent is administered at a dose of about 0.05 mg/kg to about 10.0 mg/kg of body weight of the subject.

13. The method of claim 1, wherein the RNAi agent is administered at an amount from about 50 to about 400 mg.

14. The method of claim 1, wherein the RNAi agent is administered in two or more doses.

15. The method of claim 1, wherein the subject is a human subject.

16. A method of inhibiting Xanthine Dehydrogenase (XDH) gene expression, reducing XDH mRNA expression level, or reducing XDH protein expression level in a cell comprising:

contacting an RNAi agent to the cell, thereby inhibiting XDH gene expression, reducing XDH mRNA expression level, or reducing XDH protein expression level in the cell, wherein the RNAi agent comprising a sense strand and an antisense strand, wherein the sense strand comprises a nucleic acid sequence of cucucucaGfaGfuAfuuauggaa (SEQ ID NO: 1663) and the antisense strand comprises a nucleic acid sequence of cPrpusUfscCfauaauac UfcUfgAfgagsasg (SEQ ID NO: 1146), wherein lower case (n)=2'-O-Me modified nucleotide; Nf=2'-F modified nucleotide; cPrpn=5'-cyclopropyl phosphonate-2'-O-methyl modified nucleotide; and s=phosphorothioate backbone modification.

17. The method of claim 16, wherein the XDH gene expression, the XDH mRNA expression level, or the XDH protein expression level are reduced at least about 30% relative to a cell untreated with the RNAi agent.

* * * * *